US012790400B2

(12) United States Patent
Chen et al.

(10) Patent No.: US 12,790,400 B2
(45) Date of Patent: Nov. 10, 2026

(54) ANTI-CGRP RECEPTOR/ANTI-PAC1 RECEPTOR BISPECIFIC ANTIGEN BINDING PROTEINS

(71) Applicant: AMGEN INC., Thousand Oaks, CA (US)

(72) Inventors: Irwin Chen, Los Angeles, CA (US); Su Chong, Oxnard, CA (US); Mark Leo Michaels, Encino, CA (US); Christopher Mohr, Newbury Park, CA (US); Kenneth William Walker, Newbury Park, CA (US); Zhulun Wang, Los Altos, CA (US); Neeraj Jagdish Agrawal, Natick, MA (US); Bryna Fuchslocher, Thousand Oaks, CA (US); Kevin Graham, Thousand Oaks, CA (US); Agnes Eva Hamburger, Newbury Park, CA (US); Derek E. Piper, Santa Clara, CA (US); Cen Xu, Newbury Park, CA (US)

(73) Assignee: Amgen Inc., Thousand Oaks, CA (US)

( * ) Notice: Subject to any disclaimer, the term of this patent is extended or adjusted under 35 U.S.C. 154(b) by 1072 days.

(21) Appl. No.: 17/621,189

(22) PCT Filed: Jun. 26, 2020

(86) PCT No.: PCT/US2020/039940
§ 371 (c)(1),
(2) Date: Dec. 20, 2021

(87) PCT Pub. No.: WO2020/264384
PCT Pub. Date: Dec. 30, 2020

(65) Prior Publication Data

US 2022/0363770 A1 Nov. 17, 2022

Related U.S. Application Data

(60) Provisional application No. 62/868,557, filed on Jun. 28, 2019.

(51) Int. Cl.
*C07K 16/28* (2006.01)
*C07K 16/46* (2006.01)

(52) U.S. Cl.
CPC ........ *C07K 16/2869* (2013.01); *C07K 16/468* (2013.01); *C07K 2317/24* (2013.01); *C07K 2317/51* (2013.01); *C07K 2317/515* (2013.01); *C07K 2317/565* (2013.01)

(58) Field of Classification Search
CPC .............. C07K 16/2869; C07K 16/468; C07K 2317/24; C07K 2317/51; C07K 2317/515; C07K 2317/565; C07K 2317/526; C07K 2319/50; C07K 16/28; C07K 16/18; C07K 2319/70; A61P 25/06
See application file for complete search history.

(56) References Cited

U.S. PATENT DOCUMENTS

| | | | |
|---|---|---|---|
| 5,486,472 | A | 1/1996 | Suzuki et al. |
| 5,858,787 | A | 1/1999 | Onda et al. |
| 5,866,124 | A | 2/1999 | Hardman et al. |
| 5,892,004 | A | 4/1999 | Ohtaki et al. |
| 5,973,117 | A | 10/1999 | Onda et al. |
| 6,017,533 | A | 1/2000 | Moro et al. |
| 6,242,563 | B1 | 6/2001 | Dong |
| 6,399,316 | B1 | 6/2002 | Onda et al. |
| 6,462,016 | B1 | 10/2002 | Wakita et al. |
| 7,193,070 | B2 | 3/2007 | Kane et al. |
| 7,288,251 | B2 | 10/2007 | Bedian et al. |
| 7,423,128 | B2 | 9/2008 | Gazit-Bornstein et al. |
| 7,658,924 | B2 | 2/2010 | Oliner et al. |
| 8,592,562 | B2 | 11/2013 | Kannan et al. |
| 9,072,777 | B2 | 7/2015 | Shindo |
| 9,365,653 | B2 | 6/2016 | Xu et al. |

(Continued)

FOREIGN PATENT DOCUMENTS

| | | | |
|---|---|---|---|
| CN | 102939303 | A | 2/2013 |
| EP | 0 522 159 | B1 | 12/2001 |

(Continued)

OTHER PUBLICATIONS

Kim et al., "Roles of calcitonin gene-related peptide in the skin, and other physiological and pathophysiological functions," Brain, Behavior, & Immunity—Health, 18, 100361, pp. 1-14 (2021).
Liao et al., "Targeting the PAC1 Receptor for Neurological and Metabolic Disorders," Current Topics in Medicinal Chemistry, 19:1399-1417 (2019).
Almagro and Fransson (2008), "Humanization of antibodies", Frontiers Biosci. 13:1619-1633.

(Continued)

*Primary Examiner* — Olga N Chernyshev
(74) *Attorney, Agent, or Firm* — Angela Purcell; Wyan-Ching M. Lee

(57) ABSTRACT

The present invention relates to antagonist antibodies of the human calcitonin gene-related peptide (CGRP) receptor as well as bispecific antigen binding proteins derived from the anti-CGRP antibodies that bind to and inhibit both the human CGRP receptor and another target, such as the human pituitary adenylate cyclase activating polypeptide type I receptor (PAC1) receptor. Pharmaceutical compositions comprising the anti-CGRP receptor antibodies and bispecific antigen binding proteins as well as methods for producing them are also disclosed. Methods of using the anti-CGRP receptor antibodies and bispecific antigen binding proteins to ameliorate, treat, or prevent conditions associated with the CGRP and PAC1 receptors, such as chronic pain, migraine, and cluster headache, are also described.

45 Claims, 13 Drawing Sheets

Specification includes a Sequence Listing.

(56) References Cited

U.S. PATENT DOCUMENTS

| | | | |
|---|---|---|---|
| 9,546,203 | B2 | 1/2017 | Kannan et al. |
| 9,862,771 | B2 | 1/2018 | Boone et al. |
| 10,011,858 | B2 | 7/2018 | Igawa et al. |
| 10,738,110 | B2 | 8/2020 | Agrawal et al. |
| 10,934,362 | B2 | 3/2021 | Kannan et al. |
| 11,248,043 | B2 | 2/2022 | Agrawal et al. |
| 11,891,435 | B2 | 2/2024 | Agrawal et al. |
| 11,919,964 | B2 | 3/2024 | Kannan et al. |
| 2002/0155533 | A1 | 10/2002 | Onda et al. |
| 2002/0164707 | A1 | 11/2002 | Adamou et al. |
| 2002/0182729 | A1 | 12/2002 | Dicicco-Bloom et al. |
| 2004/0110170 | A1 | 6/2004 | Pisegna |
| 2004/0132101 | A1 | 7/2004 | Lazar et al. |
| 2004/0176577 | A1 | 9/2004 | Rojer et al. |
| 2005/0129687 | A1 | 6/2005 | Vizzard et al. |
| 2005/0142133 | A1 | 6/2005 | Lazar et al. |
| 2005/0282252 | A1 | 12/2005 | Siegel et al. |
| 2006/0018909 | A1 | 1/2006 | Oliner et al. |
| 2006/0062785 | A1 | 3/2006 | Freson et al. |
| 2006/0160996 | A9 | 7/2006 | Lazar et al. |
| 2006/0246071 | A1 | 11/2006 | Green et al. |
| 2007/0054843 | A1 | 3/2007 | Yeomans et al. |
| 2008/0057063 | A1 | 3/2008 | Rinkenberger et al. |
| 2009/0215895 | A1 | 8/2009 | Ferrante et al. |
| 2009/0291900 | A1 | 11/2009 | Yeomans et al. |
| 2010/0015133 | A1 | 1/2010 | Igawa et al. |
| 2010/0112601 | A1 | 5/2010 | Shirakawa et al. |
| 2011/0021426 | A1 | 1/2011 | Toll et al. |
| 2012/0294802 | A1 | 11/2012 | Russo et al. |
| 2013/0196908 | A1 | 8/2013 | Toll et al. |
| 2015/0010560 | A1 | 1/2015 | Xu et al. |
| 2015/0376286 | A1 | 12/2015 | Boone et al. |
| 2017/0306033 | A1* | 10/2017 | Kannan .................. A61P 25/06 |
| 2024/0150448 | A1 | 5/2024 | Agrawal et al. |

FOREIGN PATENT DOCUMENTS

| | | | |
|---|---|---|---|
| EP | 2 048 162 | A1 | 4/2009 |
| EP | 1 098 906 | B1 | 11/2009 |
| EP | 1 928 484 | B1 | 2/2010 |
| EP | 2 161 282 | A1 | 3/2010 |
| JP | 2005-503809 | | 2/2005 |
| JP | 2007-525495 | A | 9/2007 |
| WO | 98/03534 | A1 | 1/1998 |
| WO | 00/05260 | A1 | 2/2000 |
| WO | 2002/066492 | A2 | 8/2002 |
| WO | 2003/027252 | A2 | 4/2003 |
| WO | 2004/014351 | A2 | 2/2004 |
| WO | 2004/062684 | A | 7/2004 |
| WO | 2004/097421 | A2 | 11/2004 |
| WO | 2004/099249 | A2 | 11/2004 |
| WO | 2005/073164 | A1 | 8/2005 |
| WO | 2005/077072 | A2 | 8/2005 |
| WO | 2006/068953 | A2 | 6/2006 |
| WO | 2006/134692 | A1 | 12/2006 |
| WO | 2007/022070 | A2 | 2/2007 |
| WO | 2007/025249 | A2 | 3/2007 |
| WO | 2007/045927 | A2 | 4/2007 |
| WO | 2007/048026 | A2 | 4/2007 |
| WO | 2007/054809 | A2 | 5/2007 |
| WO | 2007/076336 | A1 | 7/2007 |
| WO | 2008/132453 | A1 | 11/2008 |
| WO | 2009/033489 | A2 | 3/2009 |
| WO | 2009/109908 | A1 | 9/2009 |
| WO | 2010/012911 | A1 | 2/2010 |
| WO | 2010/066125 | A1 | 6/2010 |
| WO | 2010/075238 | A1 | 7/2010 |
| WO | 2010/145792 | A1 | 12/2010 |
| WO | 2011/017122 | A1 | 2/2011 |
| WO | 2011/024113 | A1 | 3/2011 |
| WO | 2011/076781 | A1 | 6/2011 |
| WO | 2012/125850 | A1 | 9/2012 |
| WO | 2013/093809 | A1 | 6/2013 |
| WO | 2013/177062 | A1 | 11/2013 |
| WO | 2014/081955 | A1 | 5/2014 |
| WO | 2014/144632 | A2 | 9/2014 |
| WO | 2016/044224 | A1 | 3/2016 |
| WO | 2019/140216 | A1 | 7/2019 |
| WO | 2019/217587 | A1 | 11/2019 |

OTHER PUBLICATIONS

Ashina et al. (1999), "Plasma levels of substance P, neuropeptide Y and vasoactive intestinal polypeptide in patients with chronic tension-type headache". Pain, 83:541-547.

Ashina et al. (2000), "Plasma levels of calcitonin gene-related peptide in chronic tension-type hcadachc", Ncurol. 55(9):1335-1340.

Bee et al. (2013), "Determining the binding affinity of therapeutic monoclonal antibodies towards their native unpurified antigens in human serum", PLOS One, 8(11)e80501:1-13.

Bendig, Mary M. (1995), "Humanization of rodent monoclonal antibodies by CDR grafting", Methods: A Companion to Methods in Enzymology, 9:83-93.

Bennett et al. (2000), "Alleviation of mechanical and thermal allodynia by $CGRP_{8-37}$ in a rodent model of chronic central pain", Pain, 86(1-2):163-175.

Berglund et al. (2008), "The epitopc space of the human protcome", Protein Sci., 17:606-613.

Booe et al. (2015), "Structural Basis for Receptor Activity-Modifying Protein-Dependent Selective Peptide Recognition by a G Protein-Coupled Receptor", Molecular Cell, 58:1040-1052.

Bourgault et al. (2009), "Molecular and conformational determinants of pituitary adenylate cyclase-activating polypeptide (PACAP) for activation of the PAC1 receptor", J. Med. Chem., 52:3308-3316.

Calcitonin receptor-like [*Homo sapiens*], NCBI Ref. Seq.: NP 005786.1 (Feb. 3, 2008).

Chauhan, M. et al. (2004), "Studies on the effects of the N-terminal domain antibodies of calcitonin receptor-like receptor and receptor activity-modifying protein 1 on calcitonin gene-related peptide-induced vasorelaxation in rat uterine artery", Biol. Reproduction, 70:1658-1663.

Colman, P.M. (1994), "Effects of amino acid sequence changes on antibody-antigen interactions", Research in Immunology, 145:33-36.

Committee on Methods of Producing Monoclonal Antibodies (1999), "Monoclonal antibody production", National Academy Press, Washington DC.

Corvera, Carlos U. et al. (2005), "Localization of calcitonin receptor-like receptor (CLR) and calcitonin gene-related peptide (CGRP) in human gut", Database Biosis, Ann. Mtg. Amer. Gastroenterol. Assoc./Digestive Disease Wk., Chicago, IL, 128(4, S2):A361.

Cottrell et al. (2005), "Localization of calcitonin receptor-like receptor and receptor activity modifying protein 1 in enteric neuron, dorsal root ganglia and the spinal cord of the rat", J. Comparative Neurol. 490:239-255.

Davis et al. (2008), "The tortuous road to an ideal CGRP function blocker for the treatment of migraine", Current Topics in Med. Chem., 8(16)1468-1479.

Dong, Yuan-Lin et al. (2004), "Involvement of calcitonin gene-related peptide in control of human fetoplacental vascular tone", Amer. J. Physiol. Heart Circulation Physiol., 286:H230-H239.

Drake et al. (2004), "Characterizing high-affinity antigen/antibody complexes by kinetic- and equilibrium-based methods", Anal. Biochem., 328(1):35-43.

Drake et al. (2012), "Biacore surface matrix effects on the binding kinetics and affinity of an antigen/antibody complex", Anal. Biochem., 429(1):58-69.

Durham et al. (2004), "CGRP-receptor antagonists-a fresh approach to migraine therapy?", N. Eng. J. Med., 350(11):1073-1075.

Durham, Paul L. (2008), "Inhibition of calcitonin gene-related peptide function: a promising strategy for treating migraine", Headache, 48:1269-1275.

Evans et al. (2000), "CGRP-RCP, a novel protein required for signal transduction at calcitonin gene-related peptide and adrenomedullin receptors", 275(40):31438-31443.

Goetzl et al., "PAC1 and VIP receptors", pp. 2249-2253, DOI:10.1006/rwcy.2000.23009.

(56) References Cited

OTHER PUBLICATIONS

Greenspan et al. (1999), "Defining epitopes: It's not as easy as it seems", Nature Biotech., 17:936-937.
Guirland et al.(2003), "Direct cAMP signaling through G-protein-coupled receptors mediates growth cone attraction induced by pituitary adenylate cyclase-activating polypeptide", J. Neurosci., 23(6):2274-2283.
Gunasekaran et al. (2010), "Enhancing Antibody Fc Heterodimer Formation through Electrostatic Steering Effects", J. Biol. Chem., 285(25): 19637-19646.
Hay, D.L. (2007), "What makes a $CGRP_2$ receptor?", Clin. Exper. Pharmacol. Physiol., 34:963-971, doi:10.1111/j.1440-1681.2007.04703.x.
Heinrich et al. (2010), "Comparison of the results obtained by ELISA and surface plasmon resonance for the determination of antibody affinity", J. Immunol. Methods, 352(1-2):13-22.
Inooka, Hiroshi et al. (2001), "Conformation of a peptide ligand bound to its G-protein coupled receptor", Nature Struct. Biol., 8(2):161-165.
The International Classification of Headache Disorders, $2^{nd}$ ed. (2004), Cephalalgia, 24(Suppl. 1):9-160.
International Search Report and Written Opinion, PCT/US2020/039940, dated Sep. 29, 2020, mailed Dec. 8, 2020.
Jafarlou et al. (2016), "An overview of the history, applications, advantages, disadvantages and prospects of gene therapy", J. Biol. Regulators & Homeostatic Agents, 30(2):315-321.
Jiang et al. (2005), "A novel peptide isolated from a phage display peptide library with trastuzumab can mimic antigen epitope of HER-2*", J. Biol. Chem., 280(6):4656-4662.
Johnson, Ginger S. et al. (2014), "Migraine prophylaxis: the race is on", Presentation at Defined Health, webinar.
Kontermann, R. (2012), "Dual targeting strategies with bispecific antibodies", mAbs, 4(2): 182-197.
Kuwasako et al. (2000), "Visualization of the calcitonin receptor-like receptor and its receptor activity-modifying proteins during internalization and recycling", J. Biol. Chem., 275(28):29602-29609.
Laburthe, Marc et al. (2007), "Class II G protein-coupled receptors for VIP and PACAP: structure, models of activation and pharmacology", Peptides, 28:1631-1639.
Lennerz et al. (2008), "Calcitonin receptor-like receptor (CLR), receptor activity-modifying protein 1 (Ramp1), and calcitonin gene-related peptide (CGRP) immunoreactivity in the rat trigeminovascular system: differences between peripheral and central CGRP receptor distribution", J. Comparative Neurol., 507(3):1277-1299.
Lerner et al. (2007), "Maxadilan, a PAC1 receptor agonist from sand flies", Peptides, 28(9):1651-1654, NIH-Public Access.
Liu et al. (2015), "A novel antibody engineering strategy for making monovalent bispecific heterodimeric IgG antibodies by electrostatic steering mechanism", J. Biol. Chem., 290(12):7535-7562.
Lloyd et al. (2009), "Modelling the human immune response: performance of a 10" human antibody repertoire against a broad panel of therapeutically relevant antigens", Protein Eng. Design & Selection, 22(3):159-168.
Mach et al. (2002), "Origins of skeletal pain: sensory and sympathetic innervation for the mouse femur", Neurosci., 113(1):155-166.
Mclatchie, L.M. et al. (1998), "RAMPs regulate the transport and ligand specificity of the calcitonin-receptor-like receptor", Nature, 393:333-339.
Moretti, C. (2006), "PACAP and type I PACAP receptors in human prostate cancer tissue", Annals NYAS, 1070(1):440-449.
Moro et al. (1999), "Functional characterization of structural alterations in the sequence of the vasodilatory peptide maxadilan yields a pituitary adenylate cyclase-activating peptide type 1 receptor-specific antagonist", J. Biol. Chem., 274(33):23103-23110.
Olesen, Jes and Ashina, Messoud (2011), "Emerging migraine treatments and drug targets", Trends in Pharm. Sci., 32(6): 353-355.
Paul, William E. (1993), "Fv structure and diversity in three dimensions", Fundamental Immunology, 3rd ed., pp. 292-295.
Perena, M.J. et al. (2000), "Neuroanatomia del dolor", Rev. Soc. Esp. Dolor, 7(Supl II): 5-10.
Perena, M.J. et al. (2000), "Neuroanatomia del dolor", Rev. Soc. Esp. Dolor, 7(Supl II): 5-10. * Machine Translation into English.
Piche-Nicholas et al. (2018), "Changes in complementarity-determining regions significantly alter IgG binding to the neonatal Fc receptor (FcRn) and pharmacokinetics", Mabs, 10(1):81-94.
Poyner et al. (2002), "International union of pharmacology, XXXII. The mammalian calcitonin gene-related peptides, adrenomedullin, amylin, and calcitonin receptors", Pharmacol. Rev., 54(2).
Receptor activity-modifying protein 1 precursor [*Homo sapiens*] NCBI Ref. Seq.: NP 005846.1 (Feb. 3, 2008).
Rubio-Beltran et al. (2018), "PACAP38 and PAC1 receptor blockade: a new target for headache?", J. Headache & Pain, 19:64.
Rudikoff, Stuart et al. (1982), "Single amino acid substitution altering antigen-binding specificity", PNAS USA, 79(6):1979-1983.
Saldanha, Jose W. (2007), "Molecular Engineering I: Humanization", Chapter 6, Handbook of Therapeutic Antibodies, Stefan Dubel ed., pp. 119-144.
Sazinsky, S.L. (2008), "Aglycosylated immunoglobulin G1 variants productively engage activating Fc receptors", PNAS, 105(51):20167-20172.
Schulz et al. (2004), "Immunocytochemical identification of VPAC1, VPAC2, and PAC1 receptors in normal and neoplastic human tissues with subtype-specific antibodies", Clin. Cancer Res., 10:8235.
Schytz, et al. (2009),"PACAP38 induces migraine-like attacks in patients with migraine without aura", Brain, 132:16-25.
Schytz, H.W. et al. (2010), "The PACAP receptor: a novel target for migraine treatment", Neurotherap., 7(2):191-196.
Scuteri et al., "New Trends in Migraine Pharmacology: Targeting Calcitonin Gene-Related Peptide (CGRP) With Monoclonal Antibodies", Frontiers in Pharmacol., vol. 10 (363), pp. 1-8 (2019).
Shen et al (2013), "PACAP and PAC1 receptor in brain development and behavior", Neuropeptides, 47:421-430.
Silberstein, SD (2013), "Emerging target-based paradigms to prevent and treat migraine", Nature, 93(1): 78-85.
Spiess et al. (2015), "Alternative molecular formats and therapeutic applications for bispecific antibodies", Molecular Immunology, 67:95-106.
Stancoviski et al. (1991), "Mechanistic aspects of the opposing effects of monoclonal antibodies to the ERBB2 receptor on tumor growth", PNAS USA, 88:8691-8695.
Taylor, Christopher K. et al. (2006), "Pharmacological characterization of novel α-calcitonin gene related peptide (CGRP) receptor peptide antagonists that are selective for human CGRP receptors", J. Pharmacol. Exper. Therap., 319(2):749-757.
Tepper et al. (2017), "Safety and efficacy of erenumab for preventive treatment of chronic migraine: a randomised, double-blind, placebo-controlled phase 2 trial", Lancet Neurol., 16:425-434.
Vaudry et al. (2000), "Pituitary adenylate cyclase-activating polypeptide and its receptors: from structure to functions", Pharmacol. Rev., 52(2):269-324.
Vaudry, David et al. (2009), "Pituitary adenylate cyclase-activating polypeptide and its receptors: 20 years after the discovery", Pharmacol. Rev., 61(3):283-357.
Wimalawansa et al. (1989), "Isolation, purification and raising of monoclonal antibodies for calcitonin gene-related peptide (CGRP) receptor", Reg. Peptides, 26(1).
Winkler, Johannes (2013), "Oligonucleotide conjugates for therapeutic applications", Ther. Deliv., 4(7):791-809.
Wyon et al. (2000), "Concentrations of calcitonin gene-related peptide and neuropeptide Y in plasma increase during flushes in postmenopausal women", Menopause, 7(1):25-30.
Zeller, J. et al. (2008), "CGRP function-blocking antibodies inhibit neurogenic vasodilatation without affecting heart rate or arterial blood pressure in the rat", British J. Pharmacol., 155(7):1093-1103.
Zvirbliene et al. (1999), "Production and characterization of monoclonal antibodies to pituitary adenylate cyclase activating polypeptide type i receptor", Hybridoma, 18(4):335-342.
Azimova et al., "Innovative methods of migraine treatment," RJM (2015) 29:27-30.

(56) References Cited

OTHER PUBLICATIONS

Pietrobon and Moskowitz, "Pathophysiology of Migraine," Ann Rev Physiol. (2013) 75:365-391.
Silberstein, "Current management migraine headache," CNS Spectrums (2017) 22:4-12.

* cited by examiner

ANTI-CGRP RECEPTOR/ANTI-PAC1 RECEPTOR BISPECIFIC ANTIGEN BINDING PROTEINS

CROSS-REFERENCE TO RELATED APPLICATIONS

This application claims the benefit of U.S. Provisional Application No. 62/868,557, filed Jun. 28, 2019, which is hereby incorporated by reference in its entirety.

DESCRIPTION OF THE TEXT FILE SUBMITTED ELECTRONICALLY

The present application contains a Sequence Listing, which has been submitted electronically in ASCII format and is hereby incorporated by reference in its entirety. The computer readable format copy of the Sequence Listing, which was created on Jun. 26, 2020, is named A-2314-WO-PCT_SeqList_ST25 and is 734 kilobytes in size.

FIELD OF THE INVENTION

The present invention relates to the field of biopharmaceuticals. In particular, the invention relates to antibodies that specifically bind to human calcitonin gene-related peptide (CGRP) receptor and potently inhibit its biological activity. The invention also includes bispecific antigen binding proteins derived from the anti-CGRP receptor antibodies that are capable of specifically binding to and inhibiting human CGRP receptor and another target, such as human pituitary adenylate cyclase-activating polypeptide type I (PAC1) receptor. The invention also relates to pharmaceutical compositions comprising the anti-CGRP receptor antibodies and bispecific antigen binding proteins as well as methods of producing and using such antibodies and bispecific antigen binding proteins.

BACKGROUND OF THE INVENTION

Migraines are episodic headaches that can involve significant pain, are often accompanied by nausea, vomiting, and extreme sensitivity to light (photophobia) and sound (phonophobia), and are sometimes preceded by sensory warning symptoms or signs (auras). Migraine is a highly prevalent disease worldwide with approximately 12% of the European population, and 18% of women, 6% of men in the United States suffering from migraine attacks (Lipton et al, Neurology, Vol. 68:343-349, 2007; Lipton et al., Headache, Vol. 41:646-657, 2001). A study to assess the prevalence of migraine in the United States reported that nearly half the migraine patient population had three or more migraines per month (Lipton et al, Neurology, Vol. 68:343-349, 2007). Additionally, migraines are associated with a number of psychiatric and medical comorbidities such as depression and vascular disorders (Buse et al., J. Neurol. Neurosurg. Psychiatry, Vol. 81:428-432, 2010; Bigal et al., Neurology, Vol. 72:1864-1871, 2009). Most of the available migraine therapies are either not well tolerated or ineffective (Loder et al., Headache, Vol. 52:930-945, 2012; Lipton et al, 2001); thus, migraine remains an unmet medical need.

A major component of migraine pathogenesis involves the activation of the trigeminovascular system. The release of trigeminal and parasympathetic neurotransmitters from perivascular nerve fibers (Sanchez-del-Rio and Reuter, Curr. Opin. Neurol., Vol. 17(3):289-93, 2004) results in vasodilation of the cranial blood vessels and has been suggested to be associated with the onset of migraine headaches (Edvinsson, Cephalagia, Vol. 33(13): 1070-1072, 2013; Goadsby et al., New Engl J Med., Vol. 346(4):257-270, 2002).

Calcitonin gene-related peptide (CGRP) belongs to the calcitonin family of peptides, which also includes calcitonin, amylin, and adrenomedullin. CGRP is a 37-amino acid peptide expressed in both the central and peripheral nervous systems, and has been implicated as a key mediator in the initiation and progression of migraine pain. In addition to its ability to act as a vasodilator, CGRP also acts as a neurotransmitter in the trigeminal ganglion and the trigeminal nucleus caudalis, facilitating synaptic transmission and pain responses (Durham et al., Curr Opin Investig Drugs, Vol. 5:731-735, 2004; Zimmermann et al., Brain Res., Vol. 724:238-245, 1996; Wang et al., Proc Natl Acad Sci USA., Vol. 92:11480-11484, 1995; Poyner, Pharmacol. Ther., Vol. 56:23-51, 1992).

The CGRP receptor is a complex composed of the G-protein coupled calcitonin-like receptor (CLR) and a single transmembrane domain protein receptor activity modifying protein (RAMP1). The CGRP receptor complex is located at sites that are relevant to migraine including the cerebrovasculature, the trigeminocervical complex in the brainstem, and the trigeminal ganglion (Zhang et al., J. Neurosci., Vol. 27: 2693-2703, 2007; Storer et al., Br J Pharmacol., Vol. 142:1171-1181, 2004; Oliver et al., J Cereb Blood Flow Metab., Vol. 22:620-629, 2002). Several lines of evidence indicate that CGRP is a potent vasodilator and nociceptive modulator that has been associated with migraine pathophysiology: (1) it is expressed in the trigeminal system, which is implicated in the pathophysiology of migraines; (2) CGRP levels are elevated in migraineurs during an attack (Bellamy et al., Headache, Vol. 46:24-33, 2006; Ashina et al., Pain, Vol. 86:133-138, 2000; Gallai et al., Cephalalgia, Vol. 15:384-390, 1995; Goadsby et al., Ann Neurol., Vol. 28:183-187, 1990; Goadsby et al., Ann Neurol., Vol. 23:193-196, 1988); (3) acute migraine therapies such as triptans restore CGRP levels to normal after treatment (Juhasz et al., Cephalalgia, Vol. 25:179-183, 2005); (4) CGRP infusion triggers the onset of migraine headaches in migraine sufferers (Petersen et al., Br J Pharmacol., Vol. 143:1074-1075, 2004; Lassen et al., Cephalalgia, Vol. 22:54-61, 2002); and (5) CGRP antagonists have demonstrated efficacy in acute migraine reversal (Connor et al., Neurology, Vol. 73:970-977, 2009; Hewitt et al., Abstract for the 14$^{th}$ Congress of the International Headache Society, 2009; LBOR3; Ho et al., Lancet, Vol. 372:2115-2123, 2008a; Ho et al., Neurology, Vol. 70:1304-1312, 2008b). Additionally, antibody antagonists directed to the CGRP ligand or CGRP receptor have demonstrated clinical efficacy in the prophylactic treatment of episodic and chronic migraine (see, e.g., Tepper et al., Lancet Neurol., Vol. 16: 425-434, 2017; Goadsby et al., New England Journal of Medicine, Vol. 377: 2123-2132, 2017; Detke et al., Neurology, Vol. 91(24):e2211-e2221, 2018; Stauffer et al., JAMA Neurol., Vol. 75(9):1080-1088, 2018).

Pituitary adenylate cyclase-activating polypeptides (PACAP) are 38-amino acid (PACAP38), or 27-amino acid (PACAP27) peptides that were first isolated from an ovine hypothalamic extract on the basis of their ability to stimulate cyclic AMP (cAMP) formation in anterior pituitary cells (Miyata et al., Biochem Biophys Res Commun., Vol. 164: 567-574, 1989; Miyata et al., Biochem Biophys Res Commun., Vol. 170:643-648, 1990). PACAP belongs to the VIP/secretin/glucagon superfamily. The sequence of PACAP27 corresponds to the 27 N-terminal amino acids of PACAP38 and shares 68% identity with vasoactive intestinal polypeptide (VIP) (Pantaloni et al., J. Biol. Chem., Vol.

271: 22146-22151, 1996; Pisegna and Wank, Proc. Natl. Acad. Sci. USA, Vol. 90: 6345-49, 1993; Campbell and Scanes, Growth Regul., Vol. 2:175-191, 1992). The major form of PACAP peptide in the human body is PACAP38, and the pharmacology of PACAP38 has not been shown to be different from the pharmacology of PACAP27. Three PACAP receptors have been reported: one receptor that binds PACAP with high affinity and has a much lower affinity for VIP (PAC1 receptor), and two receptors that recognize PACAP and VIP equally well (VPAC1 and VPAC2 receptors) (Vaudry et al., Pharmacol Rev., Vol. 61:283-357, 2009).

Human experimental migraine models using PACAP as a challenge agent to induce migraine-like headaches support the approach for antagonism of the PACAP/PAC1 signaling pathway as a treatment for migraine prophylaxis. PACAP38 is elevated in plasma during spontaneous migraine attacks in migraine patients, and these elevated PACAP38 levels can be normalized with sumatriptan, an acute migraine therapy (Tuka et al., Cephalalgia, Vol. 33: 1085-1095, 2013; Zagami et al., Ann. Clin. Transl. Neurol., Vol. 1: 1036-1040, 2014). Infusion of PACAP38 causes headaches in healthy subjects and migraine-like headaches in migraine patients (Schytz et al., Brain, Vol. 132:16-25, 2009; Amin et al., Brain, Vol. 137: 779-794, 2014; Guo et al., Cephalalgia, Vol. 37:125-135, 2017). However, in the same model, VIP does not cause migraine-like headaches in migraine patients (Rahmann et al., Cephalalgia, Vol. 28:226-236, 2008). The lack of migraine-like headache induction from VIP infusion suggests that PACAP38 peptide's effects are mediated through the PAC1 receptor, rather than VPAC1 or VPAC2 receptors, because VIP has a much higher affinity at the latter two receptors. This notion is further supported by animal studies in which PAC1 receptor antagonists inhibit nociceptive neuronal activity in the trigeminocervical complex in an in vivo model of migraine (Akerman et al., Sci. Transl. Med., Vol. 7: 308ra157, 2015; Hoffmann et al., Cephalalgia, Vol. 37 (1S): 3, Abstract OC-BA-004, 2017). Taken together, these data suggest that pharmacological agents that inhibit PACAP-activation of the PAC1 receptor have the potential to treat migraine.

Although effective migraine-specific prophylactic therapies having recently been approved and become available, there is still a need to develop additional migraine therapies with novel mechanisms of action to treat those patients who do not adequately respond to the current therapies. In particular, therapeutic molecules having a dual function in antagonizing both the CGRP/CGRP receptor and PACAP/PAC1 receptor pathways would be particularly beneficial.

SUMMARY OF THE INVENTION

The present invention provides antibodies and antigen-binding fragments that specifically bind to human CGRP receptor and potently inhibit its activity. The antibodies and antigen-binding fragments of the invention are two to four-fold more potent inhibitors of human CGRP receptor activation than previously described anti-CGRP receptor antibodies. For instance, in some embodiments, the anti-CGRP receptor antibodies and antigen-binding fragments inhibit CGRP-induced activation of human CGRP receptor with an IC50 less than 500 pM as measured by a cell-based cAMP assay. In other embodiments, the anti-CGRP receptor antibodies and antigen-binding fragments inhibit CGRP-induced activation of human CGRP receptor with an IC50 less than 200 pM as measured by a cell-based cAMP assay. In certain embodiments, the anti-CGRP receptor antibodies and antigen-binding fragments inhibit CGRP-induced activation of the human CGRP receptor with an IC50 between about 50 pM and about 400 pM as measured by a cell-based cAMP assay.

In certain embodiments, the anti-CGRP receptor antibodies or antigen-binding fragments of the invention comprise a light chain variable region comprising complementarity determining regions CDRL1, CDRL2, and CDRL3 and a heavy chain variable region comprising complementarity determining regions CDRH1, CDRH2, and CDRH3. In certain embodiments, the anti-CGRP receptor antibodies or antigen-binding fragments of the invention comprise a heavy chain variable region that comprises the sequence of SEQ ID NO: 47 with a mutation at one or more amino acid positions 28, 30, 31, 32, 54, 56, 57, 58, 59, 60, 102, 105, 107, 111, and/or 113. In such embodiments, the mutation may be selected from T28N, T28K, T28R, T28H, T28F, T28W, T28Y, S30G, S30D, S30M, S31N, S31K, S31R, S31H, S31T, F32Y, D54A, S56E, I57D, K58E, K58D, K58T, Y59H, S60Y, N102D, N102E, D105R, D105E, S107Y, S107F, H111G, K113H, or combinations thereof. In one such embodiment, the mutation is selected from T28N, T28K, T28R, T28H, S31N, S31K, S31R, S31H, N102D, N102E, or combinations thereof. In these and other embodiments, the anti-CGRP receptor antibodies or antigen-binding fragments of the invention comprise a light chain variable region that comprises the sequence of SEQ ID NO: 23 or SEQ ID NO: 24 with a mutation at one or more amino acid positions 26, 31, 32, 33, 53, 54, 56, 57, 94, 95, 96, 97, 98, and/or 100. Such mutations can include S26F, S26R, S26Y, N31R, N31I, N31W, N32S, N32Y, N32R, N32K, N32W, Y33T, Y33S, Y33A, Y33P, N53R, N53M, K54W, K54F, K54Y, P56A, S57G, S57R, S57Q, S94Y, S94W, R95Q, R95A, R95W, L96W, L96M, L96T, L96H, L96R, S97K, S97Q, S97T, S97R, A98S, A98V, V100T, V100I, or combinations thereof. In some embodiments, the mutation is selected from S26R, S26Y, N31I, N31R, N32K, N32Y, Y33A, Y33S, or combinations thereof.

In certain embodiments, the anti-CGRP receptor antibodies or antigen-binding fragments comprise a CDRH1 comprising a CDRH1 consensus sequence, a CDRH2 comprising a CDRH2 consensus sequence, and a CDRH3 comprising a CDRH3 consensus sequence. In one embodiment, the CDRH1 consensus sequence is $X_1FX_2X_3X_4GMH$ (SEQ ID NO: 471), where $X_1$ is N, K, R, H, F, W, or Y; $X_2$ is S, G, D, or M; $X_3$ is S, T, N, K, R, or H; and $X_4$ is F or Y. In another embodiment, the CDRH1 consensus sequence is $X_1FSX_2FGMH$ (SEQ ID NO: 472), where $X_1$ is N, K, R, or H and $X_2$ is S, T, N, K, R, or H. In related embodiments, the CDRH2 consensus sequence is $VISFX_1GX_2X_3X_4X_5X_6VDSVKG$ (SEQ ID NO: 473), where $X_1$ is D or A; $X_2$ is S or E; $X_3$ is I or D; $X_4$ is K, E, T, or D; $X_5$ is Y or H; and $X_6$ is S or Y. In these and other embodiments, the CDRH3 consensus sequence may be $DRLX_1YYX_2SX_3GYYX_4YX_5YYGMAV$ (SEQ ID NO: 474), where $X_1$ is N, D, or E; $X_2$ is D, E, or R; $X_3$ is S, Y, or F; $X_4$ is G or H; and $X_5$ is K or H. The CDRs in the light chain variable regions of the anti-CGRP receptor antibodies or antigen-binding fragments of the invention may also comprise consensus sequences. For example, in some embodiments, the anti-CGRP receptor antibodies or antigen-binding fragments of the invention comprise a CDRL1 comprising a CDRL1 consensus sequence, a CDRL2 comprising a CDRL2 consensus sequence, and a CDRL3 comprising a CDRL3 consensus sequence. In one embodiment, the CDRL1 consensus sequence is $SGSX_1SNIGX_2X_3X_4VS$ (SEQ ID NO: 475), where $X_1$ is F, R, Y, or S; $X_2$ is N, R, I, or W; $X_3$ is N, S, Y, R, K, or W; and $X_4$ is Y, T, S, A, or P. The CDRL2 consensus sequence may be $DNX_1X_2RX_3X_4$ (SEQ ID NO: 476), where $X_1$ is N, R, or M; $X_2$ is K, W, F, or Y; $X_3$ is P or A; and $X_4$ is S, G, R, or Q. In related embodiments, the CDRL3 consensus sequence is $GTWDX_1X_2X_3X_4X_5VX_6$ (SEQ ID NO: 477), where $X_1$ is S, Y, or W; $X_2$ is R, Q, A, or W; $X_3$ is L, W, M, T, H, or R; $X_4$ is S, K, Q, T, or R; $X_5$ is A, S, or V; and $X_6$ is V, T, or I.

In some embodiments, the anti-CGRP receptor antibodies or antigen-binding fragments of the invention comprise one or more CDRs or variable regions from any of the anti-CGRP receptor antibodies described herein. For instance, in certain embodiments, the anti-CGRP receptor antibodies or antigen-binding fragments comprise a CDRL1 comprising a sequence selected from SEQ ID NOs: 5-12; a CDRL2 comprising the sequence of SEQ ID NOs: 13-16; a CDRL3 comprising a sequence selected from SEQ ID NOs: 17-22; a CDRH1 comprising a sequence selected from SEQ ID NOs: 35-38; a CDRH2 comprising a sequence selected from SEQ ID NOs: 39-42; and a CDRH3 comprising a sequence selected from SEQ ID NOs: 44-46. The anti-CGRP receptor antibodies or antigen-binding fragments of the invention may comprise a light chain variable region that comprises a sequence that is at least 90% identical or at least 95% identical to a sequence selected from SEQ ID NOs: 23-34. In these and other embodiments, the anti-CGRP receptor antibodies or antigen-binding fragments of the invention comprise a heavy chain variable region that comprises a sequence that is at least 90% identical or at least 95% identical to a sequence selected from SEQ ID NOs: 48-53. In one embodiment, the anti-CGRP receptor antibodies or antigen-binding fragments comprise a light chain variable region comprising a sequence selected from SEQ ID NOs: 23-34 and a heavy chain variable region comprising a sequence selected from SEQ ID NOs: 48-53.

In any of the embodiments described herein, including the embodiments described above, the anti-CGRP receptor antibody or antigen-binding fragment of the invention is a monoclonal antibody or antigen-binding fragment thereof. In some embodiments, the monoclonal antibody or antigen-binding fragment thereof is a chimeric antibody or antigen-binding fragment thereof. In other embodiments, the monoclonal antibody or antigen-binding fragment thereof is a humanized antibody or antigen-binding fragment thereof. In yet other embodiments, the monoclonal antibody or antigen-binding fragment thereof is a fully human antibody or antigen-binding fragment thereof. The monoclonal antibody can be of any isotype, such as a human IgG1, IgG2, IgG3, or IgG4. In one particular embodiment, the monoclonal antibody is a human IgG1 antibody. In another particular embodiment, the monoclonal antibody is a human IgG2 antibody.

The present invention also includes bispecific antigen binding proteins derived from the anti-CGRP receptor antibodies described herein. Such bispecific antigen binding proteins are capable of specifically binding to and inhibiting human CGRP receptor and another target. In certain embodiments, the present invention provides a bispecific antigen binding protein comprising a first binding domain that specifically binds to human CGRP receptor and a second binding domain that specifically binds to human PAC1 receptor. In such embodiments, the first binding domain comprises a first light chain immunoglobulin variable region (VL1) and a first heavy chain immunoglobulin variable region (VH1), and the second binding domain comprises a second light chain immunoglobulin variable region (VL2) and a second heavy chain immunoglobulin variable region (VH2), wherein VL1 comprises (i) a CDRL1 selected from SEQ ID NOs: 5-12, (ii) a CDRL2 selected from SEQ ID NOs: 13-16, and (iii) a CDRL3 selected from SEQ ID NOs: 17-22, and VH1 comprises (i) a CDRH1 selected from SEQ ID NOs: 35-38, (ii) a CDRH2 selected from SEQ ID NOs: 39-42, and (iii) a CDRH3 selected from SEQ ID NOs: 44-46. In these and other embodiments, VL2 may comprise (i) a CDRL1 selected from SEQ ID NOs: 130-140, (ii) a CDRL2 having the sequence of SEQ ID NO: 141, and (iii) a CDRL3 selected from SEQ ID NOs: 142-145, and VH2 may comprise (i) a CDRH1 selected from SEQ ID NOs: 157-163, (ii) a CDRH2 selected from SEQ ID NOs: 164-194, and (iii) a CDRH3 selected from SEQ ID NOs: 195-198.

In some embodiments, the bispecific antigen binding protein is an antibody, such as a heterodimeric antibody. The heterodimeric antibody may comprise a first light chain and a first heavy chain from a first antibody that specifically binds to human CGRP receptor and a second light chain and second heavy chain from a second antibody that specifically binds to human PAC1 receptor. In certain embodiments, the first and second heavy chains comprise one or more charge pair mutations in the constant region (e.g. CH3 domain) to promote heterodimer formation. For instance, in some embodiments, the first heavy chain or second heavy chain comprises at least one amino acid substitution to replace lysine at position 360, 370, 392, 409, and/or 439 according to the EU numbering system with a negatively-charged amino acid (e.g. glutamic acid or aspartic acid) and the other heavy chain comprises an amino acid substitution to replace an aspartic acid at position 399 according to the EU numbering system with a positively-charged amino acid (e.g. lysine) and at least one amino acid substitution to replace a glutamic acid at position 356 and/or 357 according to the EU numbering system with a positively-charged amino acid (e.g. lysine).

In certain embodiments, the first light chain and first heavy chain (or second light chain and second heavy chain) of the heterodimeric antibodies of the invention may comprise one or more charge pair mutations to facilitate correct light-heavy chain pairing. In such embodiments, the first heavy chain may comprise an amino acid substitution introducing a charged amino acid (e.g. glutamic acid) that has the opposite charge of the amino acid introduced into the first light chain (e.g. lysine) so that the first light chain and first heavy chain are attracted to each other. The charged amino acid introduced into the second light chain (e.g. glutamic acid) would preferably have the same charge as the amino acid introduced into the first heavy chain (e.g. glutamic acid), but the opposite charge of the amino acid introduced into the second heavy chain (e.g. lysine) so that the second light chain would be attracted to the second heavy chain, but repelled from the first heavy chain. In one embodiment, the first heavy chain comprises an amino acid substitution at position 183 (according to the EU numbering system) to introduce a charged amino acid and the first light chain comprises an amino acid substitution at position 176 (according to the Kabat numbering system) to introduce a charged amino acid, wherein the charged amino acid introduced into the first heavy chain has the opposite charge of the amino acid introduced into the first light chain. In a related embodiment, the second heavy chain comprises an amino acid substitution at position 183 (according to the EU numbering system) to introduce a charged amino acid and the second light chain comprises an amino acid substitution at position 176 (according to the Kabat numbering system) to introduce a charged amino acid, wherein the charged amino acid introduced into second heavy chain has the opposite charge of the amino acid introduced into second light chain. In certain embodiments, the first heavy chain comprises a S183E mutation, the first light chain comprises a S176K mutation, the second heavy chain comprises a S183K mutation, and the second light chain comprises a S176E mutation.

In certain embodiments, the anti-CGRP receptor antibodies or heterodimeric antibodies of the invention may contain one or more modifications that affect the glycosylation of the antibodies. In some embodiments, the anti-CGRP receptor antibody or heterodimeric antibody comprises one or more mutations to reduce or eliminate glycosylation. In such embodiments, the aglycosylated antibody may comprise a mutation at amino acid position N297 (according to the EU numbering scheme), such as a N297G mutation, in one or both heavy chains. The aglycosylated antibody may comprise further mutations to stabilize the antibody structure. Such mutations can include pairs of cysteine substitutions, such as A287C and L306C, V259C and L306C, R292C and V302C, and V323C and I332C (amino acid positions according to the EU numbering scheme). In one embodiment, the aglycosylated antibody comprises R292C and V302C mutations (according to the EU numbering scheme) in one or both heavy chains. In certain embodiments, the aglycosylated anti-CGRP receptor antibody or heterodimeric antibody comprises a heavy chain constant region comprising the amino acid sequence of SEQ ID NO: 65 or SEQ ID NO: 66. The anti-CGRP receptor antibodies or heterodimeric antibodies of the invention may comprise further mutations to modulate other characteristics of the antibodies, such as pharmacokinetic properties. In one such embodiment, the anti-CGRP receptor antibody or heterodimeric antibody may comprise M252Y, S254T, and T256E mutations (positions according to EU numbering scheme) in one or both heavy chains.

The present invention also includes one or more isolated polynucleotides and expression vectors encoding any of the anti-CGRP receptor antibodies, antigen-binding fragments, and bispecific antigen binding proteins (e.g. heterodimeric antibodies) described herein or components thereof, as well as host cells, such as a CHO cells, comprising the encoding polynucleotides and expression vectors. In certain embodiments, the present invention includes methods for producing the anti-CGRP receptor antibodies, antigen-binding fragments, and bispecific antigen binding proteins (e.g. heterodimeric antibodies) described herein. In one embodiment, the method comprises culturing a host cell comprising an expression vector encoding the anti-CGRP receptor antibody or antigen-binding fragment under conditions that allow expression of the antibody or antigen-binding fragment, and recovering the antibody or antigen-binding fragment from the culture medium or host cell. In another embodiment, the method comprises culturing a host cell comprising an expression vector encoding the bispecific antigen binding protein under conditions that allow expression of the antigen binding protein, and recovering the antigen binding protein from the culture medium or host cell.

The anti-CGRP receptor antibodies, antigen-binding fragments, and bispecific antigen binding proteins (e.g. heterodimeric antibodies) described herein can be used in the manufacture of a pharmaceutical composition or medicament for the treatment of conditions associated with CGRP receptor and/or PAC1 receptor biological activity, such as headache, migraine, cluster headache, vasomotor symptoms, and chronic pain. Thus, the present invention also provides a pharmaceutical composition comprising an anti-CGRP receptor antibody, antigen-binding fragment, or bispecific antigen binding protein (e.g. heterodimeric antibody) described herein and a pharmaceutically acceptable excipient. The pharmaceutical compositions can be used in any of the methods described herein.

In certain embodiments, the present invention provides a method for treating or preventing a headache condition in a patient in need thereof comprising administering to the patient an effective amount of an anti-CGRP receptor antibody, antigen-binding fragment, or bispecific antigen binding protein (e.g. heterodimeric antibody) described herein. In some embodiments, the headache condition to be treated or prevented with the methods of the invention is migraine. The migraine can be episodic migraine or chronic migraine. In other embodiments, the headache condition to be treated or prevented with the methods of the invention is cluster headache. In certain embodiments, the methods provide prophylactic treatment for these conditions.

In some embodiments, the present invention provides a method for treating chronic pain in a patient in need thereof comprising administering to the patient an effective amount of an anti-CGRP receptor antibody, antigen-binding fragment, or bispecific antigen binding protein (e.g. heterodimeric antibody) described herein. The chronic pain syndromes to be treated according to the methods of the invention can include neuropathic pain, arthritic pain, such as pain associated with osteoarthritis or rheumatoid arthritis, and visceral pain, such as pain associated with irritable bowel syndrome, Crohn's disease, ulcerative colitis, and interstitial cystitis.

The use of the anti-CGRP receptor antibodies, antigen-binding fragments, and bispecific antigen binding proteins (e.g. heterodimeric antibodies) in any of the methods disclosed herein or for preparation of medicaments for administration according to any of the methods disclosed herein is specifically contemplated. For instance, the present invention includes an anti-CGRP receptor antibody or a bispecific antigen binding protein (e.g. heterodimeric antibody) for use in a method for treating or preventing a condition associated with CGRP receptor and/or PAC1 receptor biological activity in a patient in need thereof. The condition can include headache (e.g. migraine headache or cluster headache) and chronic pain.

The present invention also includes the use of an anti-CGRP receptor antibody or bispecific antigen binding protein (e.g. heterodimeric antibody) in the preparation of a medicament for treating or preventing a condition associated with CGRP receptor and/or PAC1 receptor biological activity in a patient in need thereof. The condition can include headache (e.g. migraine headache or cluster headache) and chronic pain.

BRIEF DESCRIPTION OF THE DRAWINGS

FIG. 3A depicts the total serum concentration over time for molecules 5601, 5602, 5603, 5604, 5605, 5606, 5607, 5608, and 5609, whereas FIG. 3B shows the serum concentration over time for the intact forms of the molecules (i.e. both binding arms intact). FIGS. 3C and 3D show the total and intact serum concentration-time profiles, respectively, for molecules 5605, 5606, and 5607.

FIG. 8A depicts the dose-response curves for WT antibody and CDRH2 D54A antibody variant (H_D54A). FIG. 8B depicts the dose-response curves for WT antibody and CDRH3 antibody variants H_Y103A, H_Y104A, H_Y109A, H_Y110A, and H_K113A. FIG. 8C depicts the dose-response curves for WT antibody and light chain antibody variants L-Y33A, L_K67A, and L_R95A.

FIG. 10A shows the binding profile for WT antibody and CDRH2 D54A antibody variant (H_D54A). FIG. 10B shows the binding profile for WT antibody and CDRH3 antibody variants H_Y103A, H_Y104A, H_Y109A, H_Y110A, and H_K113A. FIG. 10C shows the binding profile for WT antibody and light chain antibody variants L-Y33A, L_K67A, and L_R95A.

DETAILED DESCRIPTION

Figure 1:
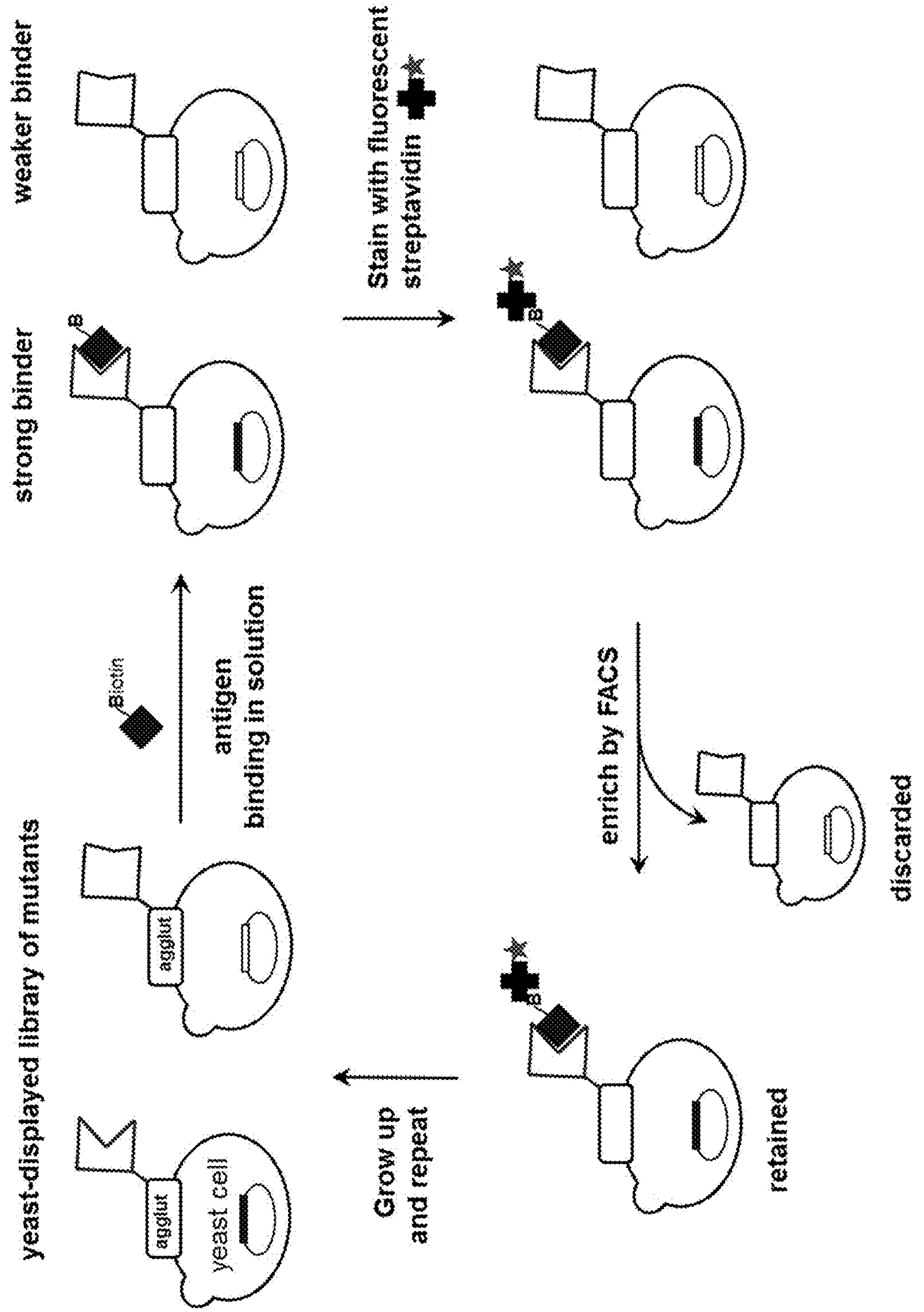
FIG. 1 is a schematic of the selection process for improved binding mutants from a yeast-displayed antibody Fab mutant library.

The present invention is based, in part, on the design and generation of high affinity antibodies that specifically bind to and potently inhibit human CGRP receptor. The antibodies of the invention are two to four-fold more potent inhibitors of human CGRP receptor activation than previously described anti-CGRP receptor antibodies. The isolated antibodies and antigen-binding fragments thereof can be used to inhibit, interfere with, or modulate the biological activity of human CGRP receptor, including inhibiting or reducing CGRP-induced activation of the CGRP receptor, inhibiting or reducing vasodilation, and ameliorating or treating symptoms of migraine and other vascular headaches. The enhanced inhibitory potency of the anti-CGRP receptor antibodies also enables the generation of bispecific antigen binding proteins capable of binding to and inhibiting human CGRP receptor and another target, such as human PAC1 receptor. Such bispecific antigen binding proteins constructed from the anti-CGRP receptor antibodies of the invention have improved inhibitory activity against the CGRP receptor as compared to bivalent monoclonal antibodies, thereby reducing effective therapeutic dosages.

Accordingly, the present invention provides isolated antibodies and antigen-binding fragments thereof that specifically bind to the calcitonin gene-related peptide (CGRP) receptor, particularly human CGRP receptor. The human CGRP receptor is a heterodimer that comprises the human calcitonin receptor-like receptor (CRLR or CLR) polypeptide (Genbank Accession No. U17473.1) and the human receptor activity modifying protein 1 (RAMP1) polypeptide (Genbank Accession No. AJ001014). The human CGRP receptor is a G protein-coupled receptor that is positively coupled to adenylate cyclase. Activation of the human CGRP receptor by CGRP results in an increase in intracellular cyclic AMP (cAMP). The amino acid sequences for the full-length human CRLR and RAMP1 polypeptides as well as extracellular domains from both polypeptides are set forth in Table 1 below.

TABLE 1

Sequences of human CRLR and human RAMP1 polypeptides

| Polypeptide | Sequence |
|---|---|
| Human CRLR | MEKKCTLYFLVLLPFFMILVTAELE ESPEDSIQLGVTRNKIMTAQYECYQ KIMQDPIQQAEGVYCNRTWDGWLCW NDVAAGTESMQLCPDYFQDFDPSEK VTKICDQDGNWFRHPASNRTWTNYT QCNVNTHEKVKTALNLFYLTIIGHG LSIASLLISLGIFFYFKSLSCQRIT LHKNLFFSFVCNSVVTIIHLTAVAN NQALVATNPVSCKVSQFIHLYLMGC NYFWMLCEGIYLHTLIVVAVFAEKQ HLMWYYFLGWGFPLIPACIHAIARS LYYNDNCWISSDTHLLYIIHGPICA ALLVNLFFLLNIVRVLITKLKVTHQ AESNLYMKAVRATLILVPLLGIEFV LIPWRPEGKIAEEVYDYIMHILMHF QGLLVSTIFCFFNGEVQAILRRNWN QYKIQFGNSFSNSEALRSASYTVST ISDGPGYSHDCPSEHLNGKSIHDIE NVLLKPENLYN (SEQ ID NO: 1) |

TABLE 1-continued

Sequences of human CRLR and human RAMP1 polypeptides

| Polypeptide | Sequence |
|---|---|
| Human RAMP 1 | MARALCRLPRRGLWLLLAHHLFMTT ACQEANYGALLRELCLTQFQVDMEA VGETLWCDWGRTIRSYRELADCTWH MAEKLGCFWPNAEVDRFFLAVHGRY FRSCPISGRAVRDPPGSILYPFIVV PITVTLLVTALVVWQSKRTEGIV (SEQ ID NO: 2) |
| Extracellular Domain of Human CRLR | ELEESPEDSIQLGVTRNKIMTAQYE CYQKIMQDPIQQAEGVYCNRTWDGW LCWNDVAAGTESMQLCPDYFQDFDP SEKVTKICDQDGNWFRHPASNRTWT NYTQCNVNTHEKVKTA (SEQ ID NO: 3) |
| Extracellular Domain of Human RAMP1 | CQEANYGALLRELCLTQFQVDMEAV GETLWCDWGRTIRSYRELADCTWHM AEKLGCFWPNAEVDRFFLAVHGRYF RSCPISGRAVRDPPGS (SEQ ID NO: 4) |

The present invention provides antibodies that specifically bind to human CGRP receptor. An antibody is a protein that comprises an antigen-binding fragment that specifically binds to an antigen, and a scaffold or framework portion that allows the antigen-binding fragment to adopt a conformation that promotes binding of the antibody to the antigen. As used herein, the term "antibody" generally refers to a tetrameric immunoglobulin protein comprising two light chain polypeptides (about 25 kDa each) and two heavy chain polypeptides (about 50-70 kDa each). The term "light chain" or "immunoglobulin light chain" refers to a polypeptide comprising, from amino terminus to carboxyl terminus, a single immunoglobulin light chain variable region (VL) and a single immunoglobulin light chain constant domain (CL). The immunoglobulin light chain constant domain (CL) can be a human kappa (κ) or human lambda (λ) constant domain. The term "heavy chain" or "immunoglobulin heavy chain" refers to a polypeptide comprising, from amino terminus to carboxyl terminus, a single immunoglobulin heavy chain variable region (VH), an immunoglobulin heavy chain constant domain 1 (CH1), an immunoglobulin hinge region, an immunoglobulin heavy chain constant domain 2 (CH2), an immunoglobulin heavy chain constant domain 3 (CH3), and optionally an immunoglobulin heavy chain constant domain 4 (CH4). Heavy chains are classified as mu (p), delta (A), gamma (γ), alpha (α), and epsilon (ε), and define the antibody's isotype as IgM, IgD, IgG, IgA, and IgE, respectively. The IgG-class and IgA-class antibodies are further divided into subclasses, namely, IgG1, IgG2, IgG3, and IgG4, and IgA1 and IgA2, respectively. The heavy chains in IgG, IgA, and IgD antibodies have three constant domains (CH1, CH2, and CH3), whereas the heavy chains in IgM and IgE antibodies have four constant domains (CH1, CH2, CH3, and CH4). The immunoglobulin heavy chain constant domains can be from any immunoglobulin isotype, including subtypes. The antibody chains are linked together via inter-polypeptide disulfide bonds between the CL domain and the CH1 domain (i.e. between the light and heavy chain) and between the hinge regions of the two antibody heavy chains.

The present invention also includes antigen-binding fragments of the anti-CGRP receptor antibodies described herein. An "antigen-binding fragment," used interchangeably herein with "binding fragment" or "fragment," is a portion of an antibody that lacks at least some of the amino acids present in a full-length heavy chain and/or light chain, but which is still capable of specifically binding to an antigen. An antigen-binding fragment includes, but is not limited to, a single-chain variable fragment (scFv), a nanobody (e.g. VH domain of camelid heavy chain antibodies; VHH fragment, see Cortez-Retamozo et al., Cancer Research, Vol. 64:2853-57, 2004), a Fab fragment, a Fab' fragment, a $F(ab)_2$ fragment, a Fv fragment, a Fd fragment, and a complementarity determining region (CDR) fragment, and can be derived from any mammalian source, such as human, mouse, rat, rabbit, or camelid. Antigen-binding fragments may compete for binding of a target antigen with an intact antibody and the fragments may be produced by the modification of intact antibodies (e.g. enzymatic or chemical cleavage) or synthesized de novo using recombinant DNA technologies or peptide synthesis. In some embodiments, the antigen-binding fragment comprises at least one CDR from an antibody that binds to the antigen, for example, the heavy chain CDR3 from an antibody that binds to the antigen. In other embodiments, the antigen-binding fragment comprises all three CDRs from the heavy chain of an antibody that binds to the antigen or all three CDRs from the light chain of an antibody that binds to the antigen. In still other embodiments, the antigen-binding fragment comprises all six CDRs from an antibody that binds to the antigen (three from the heavy chain and three from the light chain).

The term "isolated molecule" (where the molecule is, for example, a polypeptide, a polynucleotide, an antigen binding protein, an antibody, or antigen-binding fragment) is a molecule that by virtue of its origin or source of derivation (1) is not associated with naturally associated components that accompany it in its native state, (2) is substantially free of other molecules from the same species (3) is expressed by a cell from a different species, or (4) does not occur in nature. Thus, a molecule that is chemically synthesized, or expressed in a cellular system different from the cell from which it naturally originates, will be "isolated" from its naturally associated components. A molecule also may be rendered substantially free of naturally associated components by isolation, using purification techniques well known in the art. Molecule purity or homogeneity may be assayed by a number of means well known in the art. For example, the purity of a polypeptide sample may be assayed using polyacrylamide gel electrophoresis and staining of the gel to visualize the polypeptide using techniques well known in the art. For certain purposes, higher resolution may be provided by using HPLC or other means well known in the art for purification.

In certain embodiments of the invention, the antibodies or antigen-binding fragments thereof specifically bind to human CGRP receptor. An antibody, antigen-binding fragment, antigen binding protein or binding domain thereof "specifically binds" to a target antigen when it has a significantly higher binding affinity for, and consequently is capable of distinguishing, that antigen compared to its affinity for other unrelated proteins, under similar binding assay conditions. Antibodies, antigen-binding fragments, antigen binding proteins or binding domains thereof that specifically bind an antigen may have an equilibrium dissociation constant $(K_D) \leq 1\times10^{-6}$ M. The antibody, binding fragment, antigen binding protein or binding domain thereof specifically binds antigen with "high affinity" when the $K_D$ is $\leq 1\times10^{-8}$ M. In one embodiment, the antibodies or binding fragments of the invention bind to human CGRP receptor with a $K_D$ of $\leq 5\times10^{-9}$M. In another embodiment, the antibodies or binding fragments of the invention bind to human CGRP receptor with a $K_D$ of $\leq 1\times10^{-9}$M. In yet another embodiment, the antibodies or binding fragments of the invention bind to human CGRP receptor with a $K_D$ of $\leq 5\times10^{-10}$ M. In another embodiment, the antibodies or binding fragments of the invention bind to human CGRP receptor with a $K_D$ of $\leq 1\times10^{-10}$ M. In certain embodiments, the antibodies or binding fragments of the invention bind to human CGRP receptor with a $K_D$ of $\leq 5\times10^{-11}$M. In other embodiments, the antibodies or binding fragments of the invention bind to human CGRP receptor with a $K_D$ of $\leq 1\times10^{-11}$M. In one particular embodiment, the antibodies or binding fragments of the invention bind to human CGRP receptor with a $K_D$ of $\leq 5\times10^{-12}$ M. In another particular embodiment, the antibodies or binding fragments of the invention bind to human CGRP receptor with a $K_D$ of $\leq 1\times10^{-12}$ M.

Affinity is determined using a variety of techniques, an example of which is an affinity ELISA assay. In various embodiments, affinity is determined by a surface plasmon resonance assay (e.g., BIAcore®-based assay). Using this methodology, the association rate constant ($k_a$ in $M^{-1}s^{-1}$) and the dissociation rate constant ($k_d$ in $s^{-1}$) can be measured. The equilibrium dissociation constant ($K_D$ in M) can then be calculated from the ratio of the kinetic rate constants ($k_d/k_a$). In some embodiments, affinity is determined by a kinetic method, such as a Kinetic Exclusion Assay (KinExA) as described in Rathanaswami et al. Analytical Biochemistry, Vol. 373:52-60, 2008. Using a KinExA assay, the equilibrium dissociation constant ($K_D$ in M) and the association rate constant ($k_a$ in $M^{-1}s^{-1}$) can be measured. The dissociation rate constant ($k_d$ in $s^{-1}$) can be calculated from these values ($K_D \times k_a$). In other embodiments, affinity is determined by a bio-layer interferometry method, such as that described in Kumaraswamy et al., Methods Mol. Biol., Vol. 1278:165-82, 2015 and employed in Octet® systems (Pall ForteBio). The kinetic ($k_a$ and $k_d$) and affinity ($K_D$) constants can be calculated in real-time using the bio-layer interferometry method. In some embodiments, the antibodies, binding fragments, antigen binding proteins or binding domains thereof described herein exhibit desirable characteristics such as binding avidity as measured by $k_d$ (dissociation rate constant) for human CGRP receptor of about $10^{-2}$, $10^{-3}$, $10^{-4}$, $10^{-5}$, $10^{-6}$, $10^{-7}$, $10^{-8}$, $10^{-9}$, $10^{-10}$ $s^{-1}$ or lower (lower values indicating higher binding avidity), and/or binding affinity as measured by $K_D$ (equilibrium dissociation constant) for human CGRP receptor of about $10^{-8}$, $10^{-9}$, $10^{-10}$, $10^{-11}$, $10^{-12}$M or lower (lower values indicating higher binding affinity).

Preferably, the antibodies, binding fragments, antigen binding proteins or binding domains thereof of the invention do not significantly bind to or cross-react with other members of the calcitonin family of receptors, such as the human adrenomedullin 1 (AM1), human adrenomedullin 2 (AM2), or human amylin (e.g. human AMY1 receptor) receptors. An antibody, binding fragment, antigen binding protein or binding domain thereof does "not significantly bind" to a target antigen when it has a binding affinity for that antigen that is comparable to its affinity for other unrelated proteins, under similar binding assay conditions. Antibodies, binding fragments, antigen binding proteins or binding domains thereof that do not significantly bind to a target antigen may also include those proteins that do not generate a statistically different signal than a negative control in an affinity assay, such as those described herein, for the target antigen. By way of example, an antibody, which produces a signal value in an ELISA- or a surface plasmon resonance-based assay (e.g. BIAcore®-based assay) for determining binding to human AM1 receptor that is not statistically different from the signal value produced with a negative control (e.g. buffer solution without antibody), would be considered to not significantly bind to human AM1 receptors. Antibodies, binding fragments, antigen binding proteins or binding domains thereof that do not significantly bind an antigen may have an equilibrium dissociation constant ($K_D$) for that antigen greater than $1\times10^{-6}$ M, greater than $1\times10^{-5}$M, greater than $1\times10^{-4}$ M, or greater than $1\times10^{-3}$M. Thus, in certain embodiments, the antibodies, binding fragments, antigen binding proteins or binding domains thereof of the invention selectively bind to human CGRP receptor relative to human AM1, human AM2, and human amylin (e.g. human AMY1 receptor) receptors. In other words, the antibodies, binding fragments, antigen binding proteins or binding domains thereof of the invention do not significantly bind to human AM1, human AM2, or human amylin (e.g. human AMY1 receptor) receptors.

The antibodies, antigen-binding fragments, antigen binding proteins or binding domains thereof of the invention may inhibit, interfere with, or modulate one or more biological activities of the human CGRP receptor. Biological activities of the human CGRP receptor include, but are not limited to, induction of CGRP-mediated receptor signal transduction pathways, induction of vasodilation, and inhibition of vasoconstriction. In some embodiments, the antibodies, binding fragments, antigen binding proteins or binding domains thereof of the invention inhibit binding of CGRP to the human CGRP receptor. "Inhibition of binding" occurs when an excess of antibodies, binding fragments, or antigen binding proteins reduces the quantity of human CGRP receptor bound to CGRP, or vice versa, for example, by at least about 40%, about 50%, about 60%, about 70%, about 80%, about 85%, about 90%, about 95%, about 97%, about 99% or more, for example by measuring binding in an in vitro competitive binding assay. Inhibitory constants (Ki), which are indicative of how potent the antibodies, antigen-binding fragments, and antigen binding proteins of the invention are at preventing binding of CGRP to human CGRP receptor, can be calculated from such competitive binding assays. By way of example, a radioactive isotope (e.g. $^{125}$I) is attached to the receptor ligand (e.g. CGRP) and the assay measures the binding of the radiolabeled ligand to human CGRP receptor in increasing concentrations of the anti-CGRP receptor antibody, binding fragment, or antigen binding protein. The Ki value can be calculated using the equation Ki=IC50/(1+([L]/Kd)), where [L] is the concentration of the radioligand used (e.g., CGRP) and Kd is the dissociation constant of the radioligand. See, e.g., Keen M, MacDermot J (1993) Analysis of receptors by radioligand binding. In: Wharton J, Polak J M (eds) Receptor autoradiography, principles and practice. Oxford University Press, Oxford. The lower the value of Ki for an antagonist, the more potent the antagonist is. In some embodiments, the antibodies, antigen-binding fragments, or antigen binding proteins of the invention compete for binding to the human CGRP receptor with a radiolabeled CGRP ligand with a Ki of ≤1 nM. In other embodiments, the antibodies, antigen-binding fragments, or antigen binding proteins of the invention compete for binding to the human CGRP receptor with a radiolabeled CGRP ligand with a Ki of ≤500 pM. In yet other embodiments, the antibodies, antigen-binding fragments, or antigen binding proteins of the invention compete for binding to the human CGRP receptor with a radiolabeled CGRP ligand with a Ki of ≤200 pM. In certain other embodiments, the antibodies, antigen-binding fragments, or antigen binding proteins of the invention compete for binding to the human CGRP receptor with a radiolabeled CGRP ligand with a Ki of ≤100 pM.

In certain embodiments, the antibodies, antigen-binding fragments, or antigen binding proteins of the invention inhibit ligand-induced activation of the human CGRP receptor. The ligand can be the primary endogenous ligand of the receptor, such as CGRP, or the ligand can be another known agonist of the receptor. Various assays for assessing activation of CGRP receptors are known in the art and include cell-based assays measuring ligand-induced calcium mobilization and cAMP production. An exemplary cell-based cAMP assay is described in Example 1. Other suitable CGRP receptor activation assays are described in Aiyar et al., Molecular and Cellular Biochemistry, Vol. 197:179-185, 1999; Pin et al., European Journal of Pharmacology, Vol. 577: 7-16, 2007; U.S. Pat. No. 8,168,592, and WO 2010/075238, all of which are hereby incorporated by reference in their entireties.

The inhibitory activity of the antibodies, antigen-binding fragments, or antigen binding proteins on CGRP receptor activation can be quantitated by calculating an IC50 in any functional assay for the receptor, such as those described above. An "IC50" is the dose/concentration required to achieve 50% inhibition of a biological or biochemical function. With radioactive ligands, IC50 is the concentration of a competing ligand that displaces 50% of the specific binding of the radioligand. The IC50 of any particular substance or antagonist can be determined by constructing a dose-response curve and examining the effect of different concentrations of the drug or antagonist on reversing agonist activity in a particular functional assay. IC50 values can be calculated for a given antagonist or drug by determining the concentration needed to inhibit half of the maximum biological response of the agonist. Thus, the IC50 value for any anti-CGRP receptor antigen binding protein, antibody or binding fragment of the invention can be calculated by determining the concentration of the antigen binding protein, antibody or binding fragment needed to inhibit half of the maximum biological response of the ligand (e.g. CGRP) in activating the human CGRP receptor in any functional assay, such as the cAMP assay described in the Examples. An anti-CGRP receptor antigen binding protein, antibody or binding fragment that inhibits ligand-induced (e.g. CGRP-induced) activation of the CGRP receptor is understood to be a neutralizing or antagonist antigen binding protein, antibody or binding fragment of the CGRP receptor.

In certain embodiments, the antigen binding proteins, antibodies or antigen-binding fragments of the invention inhibit CGRP-induced activation of the human CGRP receptor. For instance, the antigen binding proteins, antibodies or antigen-binding fragments may inhibit CGRP-induced activation of the human CGRP receptor with an IC50 less than about 5 nM, less than about 3 nM, less than about 1 nM, less than about 800 pM, less than about 500 pM, less than about 400 pM, less than about 300 pM, less than about 200 pM, or less than about 150 pM as measured by a cell-based calcium mobilization assay or cAMP assay. In one particular embodiment, the antigen binding proteins, antibodies or antigen-binding fragments of the invention inhibit CGRP-induced activation of the human CGRP receptor with an IC50 less than about 5 nM as measured by a cell-based cAMP assay. In another particular embodiment, the antigen binding proteins, antibodies or antigen-binding fragments of the invention inhibit CGRP-induced activation of the human CGRP receptor with an IC50 less than about 1 nM as measured by a cell-based cAMP assay. In still another particular embodiment, the antigen binding proteins, antibodies or antigen-binding fragments of the invention inhibit CGRP-induced activation of the human CGRP receptor with an IC50 less than about 500 pM as measured by a cell-based cAMP assay. In another embodiment, the antigen binding proteins, antibodies or antigen-binding fragments of the invention inhibit CGRP-induced activation of the human CGRP receptor with an IC50 less than about 400 pM as measured by a cell-based cAMP assay. In another embodiment, the antigen binding proteins, antibodies or antigen-binding fragments of the invention inhibit CGRP-induced activation of the human CGRP receptor with an IC50 less than about 200 pM as measured by a cell-based cAMP assay. In some embodiments, the antigen binding proteins, antibodies or antigen-binding fragments of the invention inhibit CGRP-induced activation of the human CGRP receptor with an IC50 between about 0.1 nM and about 1 nM as measured by a cell-based cAMP assay. In other embodiments, the antigen binding proteins, antibodies or antigen-binding fragments of the invention inhibit CGRP-induced activation of the human CGRP receptor with an IC50 between about 50 pM and about 400 pM as measured by a cell-based cAMP assay. In still other embodiments, the antigen binding proteins, antibodies or antigen-binding fragments of the invention inhibit CGRP-induced activation of the human CGRP receptor with an IC50 between about 100 pM and about 350 pM as measured by a cell-based cAMP assay.

In some embodiments, the antigen binding proteins, antibodies or antigen-binding fragments of the invention selectively inhibit the human CGRP receptor relative to the human AM1, human AM2, and/or human amylin receptors (e.g. human AMY1 receptor). The human AM1 receptor is comprised of a human CRLR polypeptide and a RAMP2 polypeptide, whereas the human AM2 receptor is comprised of a human CRLR polypeptide and a RAMP3 polypeptide. Thus, an antibody or other binding protein that binds only CRLR (and not RAMP1) would not be expected to selectively inhibit the CGRP receptor because the CRLR polypeptide is also a component of the AM1 and AM2 receptors. The human amylin (AMY) receptors are comprised of a human calcitonin receptor (CT) polypeptide and one of the RAMP1, RAMP2, or RAMP3 subunits. Specifically, the human AMY1 receptor is composed of the CT polypeptide and the RAMP1 polypeptide, the human AMY2 receptor is composed of the CT polypeptide and the RAMP2 polypeptide, and the human AMY3 receptor is composed of the CT polypeptide and the RAMP3 polypeptide. Thus, an antibody or other binding protein that binds only RAMP1 (and not CRLR) would not be expected to selectively inhibit the CGRP receptor because the RAMP1 polypeptide is also a component of the human AMY1 receptor. An antigen binding protein, antibody or antigen-binding fragment "selectively inhibits" a specific receptor relative to other receptors when the IC50 of the antigen binding protein, antibody, or antigen-binding fragment in an inhibition assay of the specific receptor is at least 50-fold lower than the IC50 in an inhibition assay of another "reference" receptor, e.g., a human AM1, human AM2, or human amylin receptor. As described above, the IC50 value for any anti-CGRP receptor antigen binding protein, antibody, or antigen-binding fragment can be calculated by determining the concentration of the antigen binding protein, antibody, or antigen-binding fragment needed to inhibit half of the maximum biological response of the CGRP ligand in activating the human CGRP receptor in any functional assay, such as the cAMP assay described in the Examples.

The anti-CGRP receptor antibodies, antigen-binding fragments, antigen binding proteins or binding domains thereof of the invention may, in some embodiments, bind to a particular region or epitope of the human CGRP receptor. For instance, in certain embodiments, the anti-CGRP receptor antibody or antigen-binding fragment specifically binds to residues or sequences of residues, or regions in both human CRLR and human RAMP1 polypeptides. In one embodiment, the anti-CGRP receptor antibody or antigen-binding fragment specifically binds to an epitope formed from amino acids in both human CRLR and human RAMP1 polypeptides (e.g., SEQ ID NOs: 1 and 2, respectively). In another embodiment, the anti-CGRP receptor antibody or antigen-binding fragment specifically binds to an epitope formed from amino acids in the extracellular domains of both human CRLR and human RAMP1 polypeptides (e.g., SEQ ID NOs: 3 and 4, respectively). In some embodiments, the epitope formed from amino acids in both human CRLR and human RAMP1 polypeptides comprises one or more cleavage sites for AspN protease, which cleaves peptides after aspartic acid residues and some glutamic acid residues at the amino end. As used herein, an "epitope" refers to any determinant capable of being specifically bound by an antibody or antigen-binding fragment thereof. An epitope is a region of an antigen that is bound by, or interacts with, an antibody or binding fragment that targets that antigen, and when the antigen is a protein, includes specific amino acids that directly contact, or interact with, the antibody or binding fragment. An epitope can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or 4 amino acids, and more usually, at least 5, at least 6, or at least 7 amino acids, for example, about 8 to about 10 amino acids in a unique sequence. A "conformational epitope," in contrast to a linear epitope, is a group of discontinuous amino acids (e.g., in a polypeptide, amino acid residues that are not contiguous in the polypeptide's primary sequence but that, in the context of the polypeptide's tertiary and quaternary structure, are near enough to each other to be bound by an antibody or binding fragment thereof).

In certain embodiments, the anti-CGRP receptor antibody or antigen-binding fragment specifically binds to the extracellular domain of human CRLR polypeptide comprising the amino acid sequence of SEQ ID NO: 3 and/or the extracellular domain of human RAMP1 polypeptide comprising the amino acid sequence of SEQ ID NO: 4. As described in Example 5, a crystal structure of the complex of the human CRLR N-terminal extracellular domain (ECD), the human RAMP1 N-terminal ECD and the Fab region of an anti-CGRP receptor antagonist antibody revealed key amino acids within the CRLR/RAMP1 heterodimer (i.e. human CGRP receptor) that comprised the binding interface with the anti-CGRP receptor Fab. These core interface amino acids, all of which contained at least one non-hydrogen atom at a distance of 5.0 Å or less from a non-hydrogen atom in the Fab, include E23, L24, E25, E26, E29, R38, I41, M42, D70, G71, W72, F92, D94, F95, K103, H114, A116, S117, R119, T120, W121, T122, Y124, N128, T131, H132, and E133 in the CRLR polypeptide (amino acid position numbers relative to SEQ ID NO: 1) and R67, A70, D71, W74, E78, C82, F83, W84, and P85 in the RAMP1 polypeptide (amino acid position numbers relative to SEQ ID NO: 2). Thus, in some embodiments, the anti-CGRP receptor antibodies or antigen-binding fragments of the invention bind to human CGRP receptor at an epitope comprising one or more amino acids selected from E23, L24, E25, E26, E29, R38, I41, M42, D70, G71, W72, F92, D94, F95, K103, H114, A116, S117, R119, T120, W121, T122, Y124, N128, T131, H132, and E133 in the human CRLR polypeptide of SEQ ID NO: 1 and one or more amino acids selected from R67, A70, D71, W74, E78, C82, F83, W84, and P85 in the human RAMP1 polypeptide of SEQ ID NO: 2. In other embodiments, the anti-CGRP receptor antibodies or antigen-binding fragments of the invention bind to human CGRP receptor at an epitope comprising one or more amino acids selected from E23, L24, E25, E26, R38, I41, D70, W72, D94, H114, A116, S117, R119, T120, Y124, T131, H132, and E133 in the human CRLR polypeptide of SEQ ID NO: 1 and one or more amino acids selected from A70, D71, W74, E78, and W84 in the human RAMP1 polypeptide of SEQ ID NO: 2.

The crystal structure of the human CGRP ECD-Fab complex described in Example 5 also revealed important residues in the CDRs of the heavy and light chains of the Fab that interacted with the amino acids in the human CRLR ECD and human RAMP1 ECD polypeptides, thereby identifying key amino acids in the paratope of the antibody. A "paratope" is the region of an antibody that recognizes and binds to the target antigen. Paratope residues within 5.0 Å or less of residues in the CRLR ECD and RAMP1 ECD polypeptides include S26, S27, G30, N31, N32, Y33, D51, N52, K67, S94, and R95 in the light chain variable region (SEQ ID NO: 23) and T28, S31, F53, D54, G55, S56, L101, N102, Y103, Y104, D105, S106, S107, G108, Y109, Y110, H111, K113, and Y115 in the heavy chain variable region (SEQ ID NO: 47). Specific mutations of several of these residues or adjacent residues in the paratope were designed to improve the interaction with the core interface residues (i.e. residues in the epitope) in the human CGRP receptor to improve the binding affinity and/or inhibitory potency of the resulting variant anti-CGRP receptor antibodies. See Examples 1 and 5.

The analysis of the paratope/epitope interface described in Example 5 revealed that the heavy chain variable region, particularly CDRH3, plays an important role in the inhibitory function and selectivity of the anti-CGRP receptor antibody for the CGRP receptor as paratope residues in the heavy chain interact with amino acids in both the CRLR and RAMP1 polypeptide components of the receptor. Thus, in certain embodiments, the anti-CGRP receptor antibodies, antigen-binding fragments, antigen binding proteins or binding domains thereof of the invention comprise a heavy chain variable region comprising complementarity determining regions CDRH1, CDRH2, and CDRH3, wherein the heavy chain variable region comprises the sequence of SEQ ID NO: 47 with a mutation at one or more amino acid positions 28, 30, 31, 32, 54, 56, 57, 58, 59, 60, 102, 105, 107, 111, and/or 113. In such embodiments, the mutation can be selected from T28N, T28K, T28R, T28H, T28F, T28W, T28Y, S30G, S30D, S30M, S31N, S31K, S31R, S31H, S31T, F32Y, D54A, S56E, I57D, K58E, K58D, K58T, Y59H, S60Y, N102D, N102E, D105R, D105E, S107Y, S107F, H111G, K113H, or combinations thereof. In some embodiments, the mutation is selected from T28N, T28K, T28R, T28H, S31N, S31K, S31R, S31H, N102D, N102E, or combinations thereof. In these and other embodiments, the CDRH3 of the anti-CGRP receptor antibody or antigen-binding fragment is more than 15 amino acids in length, for example, from about 18 to about 25 amino acids in length. As described in Example 5, the potency of the anti-CGRP receptor antibodies is directly correlated with the length of the CDRH3 region with greater potency observed for antibodies having longer CDRH3 regions. Without being bound by theory, it is believed that the long CDRH3 region enables the antibody to effectively bind to a recessed epitope deep in the CRLR/RAMP1 interface. See FIG. 7B.

In certain related embodiments, the anti-CGRP receptor antibodies, antigen-binding fragments, antigen binding proteins or binding domains thereof of the invention comprise a light chain variable region comprising complementarity determining regions CDRL1, CDRL2, and CDRL3, wherein the light chain variable region comprises the sequence of SEQ ID NO: 23 or SEQ ID NO: 24 with a mutation at one or more amino acid positions 26, 31, 32, 33, 53, 54, 56, 57, 94, 95, 96, 97, 98, and/or 100. In some embodiments, the mutation is selected from S26F, S26R, S26Y, N31R, N31I, N31W, N32S, N32Y, N32R, N32K, N32W, Y33T, Y33S, Y33A, Y33P, N53R, N53M, K54W, K54F, K54Y, P56A, S57G, S57R, S57Q, S94Y, S94W, R95Q, R95A, R95W, L96W, L96M, L96T, L96H, L96R, S97K, S97Q, S97T, S97R, A98S, A98V, V100T, V100I, or combinations thereof. In one particular embodiment, the mutation is selected from S26R, S26Y, N31I, N31R, N32K, N32Y, Y33A, Y33S, or combinations thereof.

The antibodies, antigen-binding fragments, antigen binding proteins or binding domains thereof of the invention may comprise one or more complementarity determining regions (CDR) from the light and heavy chain variable regions of antibodies that specifically bind to human CGRP receptor as described herein. The term "CDR" refers to the complementarity determining region (also termed "minimal recognition units" or "hypervariable region") within antibody variable sequences. There are three heavy chain variable region CDRs (CDRH1, CDRH2 and CDRH3) and three light chain variable region CDRs (CDRL1, CDRL2 and CDRL3). The term "CDR region" as used herein refers to a group of three CDRs that occur in a single variable region (i.e. the three light chain CDRs or the three heavy chain CDRs). The CDRs in each of the two chains typically are aligned by the framework regions (FRs) to form a structure that binds specifically with a specific epitope or domain on the target protein (e.g., human CGRP receptor). From N-terminus to C-terminus, naturally-occurring light and heavy chain variable regions both typically conform with the following order of these elements: FR1, CDR1, FR2, CDR2, FR3, CDR3 and FR4. A numbering system has been devised for assigning numbers to amino acids that occupy positions in each of these domains. This numbering system is defined in Kabat Sequences of Proteins of Immunological Interest (1987 and 1991, NIH, Bethesda, MD), or Chothia & Lesk, 1987, *J. Mol. Biol.* 196:901-917; Chothia et al., 1989, Nature 342: 878-883. Complementarity determining regions (CDRs) and framework regions (FR) of a given antibody may be identified using this system. Other numbering systems for the amino acids in immunoglobulin chains include IMGT® (the international ImMunoGeneTics information system; Lefranc et al., Dev. Comp. Immunol. 29:185-203; 2005) and AHo (Honegger and Pluckthun, J. Mol. Biol. 309(3):657-670; 2001).

In certain embodiments, the antibodies, antigen-binding fragments, antigen binding proteins or binding domains thereof of the invention that specifically bind to human CGRP receptor comprise at least one light chain variable region comprising a CDRL1, CDRL2, and CDRL3, and at least one heavy chain variable region comprising a CDRH1, CDRH2, and CDRH3 from any of the anti-CGRP receptor antibodies described herein. Light chain and heavy chain variable regions and associated CDRs of exemplary human anti-CGRP receptor antibodies are set forth below in Tables 2A and 2B, respectively.

TABLE 2A

Exemplary Anti-Human CGRP Receptor Antibody Light Chain Variable Region Amino Acid Sequences

| Antibody ID. | VL Group | VL Amino Acid Sequence | CDRL1 | CDRL2 | CDRL3 |
|---|---|---|---|---|---|
| 4E4, 03, 03A, 03B | LV-01 | QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLG (SEQ ID NO: 23) | SGSSSNIGNNYVS (SEQ ID NO: 5) | DNNKRPS (SEQ ID NO: 13) | GTWDSRLSAVV (SEQ ID NO: 17) |
| 4E4.2, 04, 07, 09, 10 | LV-02 | QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVLG (SEQ ID NO: 24) | SGSSSNIGNNYVS (SEQ ID NO: 5) | DNNKRPS (SEQ ID NO: 13) | GTWDSRLSAVV (SEQ ID NO: 17) |
| 01,01A, 01B, 01C, 01D, 01E, 01F, 01G | LV-03 | QSVLTQPPSVSAAPGQKVTISCSGSYSNIGRYSVSWYQQLPGTAPKLLIYDNNKRPSGIPDRFSGSKSGTSATLGITGLQTGDEADYYCGTWDSRLSAVVFGGGTKLTVLG (SEQ ID NO: 25) | SGSYSNIGRYSVS (SEQ ID NO: 6) | DNNKRPS (SEQ ID NO: 13) | GTWDSRLSAVV (SEQ ID NO: 17) |
| 02, 02A, 02B | LV-04 | QSVLTQPPSVSAAPGQKVTISCSGSRSNIGIKAVSWYQQLPGTAPKLLIYDNNKRPSGIPDRFSGSKSGTSATLGITGLQTGDEADYYCGTWDSRLSAVVFGGGTKLTVLG (SEQ ID NO: 26) | SGSRSNIGIKAVS (SEQ ID NO: 7) | DNNKRPS (SEQ ID NO: 13) | GTWDSRLSAVV (SEQ ID NO: 17) |
| 05 | LV-05 | QSVLTQPPSVSAAPGQKVTISCSGSFSNIGRSTVSWYQQLPGTAPKLLIYDNRWRAGGIPDRFSGSKSGTSATLGITGLQTGDEADYYCGTWDYQWKAVVFGGGTKLTVLG (SEQ ID NO: 27) | SGSFSNIGRSTVS (SEQ ID NO: 8) | DNRWRAG (SEQ ID NO: 14) | GTWDYQWKAVV (SEQ ID NO: 18) |
| 06 | LV-06 | QSVLTQPPSVSAAPGQKVTISCSGSYSNIGRKSVSWYQQLPGTAPKLLIYDNNKRPSGIPDRFSGSKSGTSATLGITGLQTGDEADYYCGTWDSRLSAVVFGGGTKLTVLG (SEQ ID NO: 28) | SGSYSNIGRKSVS (SEQ ID NO: 9) | DNNKRPS (SEQ ID NO: 13) | GTWDSRLSAVV (SEQ ID NO: 17) |
| 08 | LV-07 | QSVLTQPPSVSAAPGQKVTISCSGSYSNIGWWPVSWYQQLPGTAPKLLIYDNNKRPSGIPDRFSGSKSGTSATLGITGLQTGDEADYYCGTWDSRLSAVVFGGGTKLTVLG (SEQ ID NO: 29) | SGSYSNIGWWPVS (SEQ ID NO: 10) | DNNKRPS (SEQ ID NO: 13) | GTWDSRLSAVV (SEQ ID NO: 17) |
| 11 | LV-08 | QSVLTQPPSVSAAPGQKVTISCSGSRSNIGRYSVSWYQQLPGTAPKLLIYENMFRPRGIPDRFSGSKSGTSATLGITGLQTGDEADYYCGTWDYRMQAVVFGGGTKLTVLG (SEQ ID NO: 30) | SGSRSNIGRYSVS (SEQ ID NO: 11) | ENMFRPR (SEQ ID NO: 15) | GTWDYRMQAVV (SEQ ID NO: 19) |
| 12 | LV-09 | QSVLTQPPSVSAAPGQKVTISCSGSRSNIGRYSVSWYQQLPGTAPKLLIYDNRYRAQGIPDRFSGSKSGTSATLGITGLQTGDEADYYCGTWDWATTSWFGGGTKLTVLG (SEQIDNO: 31) | SGSRSNIGRYSVS (SEQIDNO: 11) | DNRYRAQ (SEQ ID NO: 16) | GTWDWATTSW (SEQ ID NO: 20) |
| 13 | LV-10 | QSVLTQPPSVSAAPGQKVTISCSGSRSNIGRRTVSWYQQLPGTAPKLLIYDNNKRPSGIPDRFSGSKSGTSATLGITGLQTGDEADYYCGTWD SRL SA WFGGGTKLTVLG (SEQ ID NO: 32) | SGSRSNIGRRTVS (SEQ ID NO: 12) | DNNKRPS (SEQ ID NO: 13) | GTWDSRLSAVV (SEQ ID NO: 17) |

TABLE 2A-continued

Exemplary Anti-Human CGRP Receptor Antibody Light Chain Variable Region Amino Acid Sequences

| Antibody ID. | VL Group | VL Amino Acid Sequence | CDRL1 | CDRL2 | CDRL3 |
|---|---|---|---|---|---|
| 14 | LV-11 | QSVLTQPPSVSAAPGQKVTISC SGSSSNIGNNYVSWYQQLPGT APKLLIYDNNKRPSGIPDRFSG SKSGTSATLGITGLQTGDEAD YYCGTWDSWHRVVTFGGGTK LTVLG (SEQ ID NO: 33) | SGSSSNIGNNYVS (SEQ ID NO: 5) | DNNKRPS (SEQ ID NO: 13) | GTWDSWHRVV T (SEQ ID NO: 21) |
| 15 | LV-12 | QSVLTQPPSVSAAPGQKVTISC SGSSSNIGNNYVSWYQQLPGT APKLLIYDNNKRPSGIPDRFSG SKSGTSATLGITGLQTGDEAD YYCGTWDWWRKAVIFGGGT KLTVLG (SEQ ID NO: 34) | SGSSSNIGNNYVS (SEQ ID NO: 5) | DNNKRPS (SEQ ID NO: 13) | GTWDWWRKAV 1 (SEQ ID NO: 22) |

TABLE 2B

Exemplary Anti-Human CGRP Receptor Antibody Heavy Chain Variable Region Amino Acid Sequences

| Antibody ID. | VH Group | VH Amino Acid Sequence | CDRH1 | CDRH2 | CDRH3 |
|---|---|---|---|---|---|
| 4E4 | HV-01 | QVQLVESGGGVVQPGRSLRLS CAASGFTFSSFGMHWVRQAPG KGLEWVAVISFDGSIKYSVDS VKGRFTISRDNSKNTLFLQMN SLRAEDTAVYYCARDRLNYY DSSGYYHYKYYGMAVWGQG TTVTVSS (SEQ ID NO: 47) | SFGMH (SEQ ID NO: 35) | VISFDGSIKYS VDSVKG (SEQ ID NO: 39) | DRLNYYDSSGYY HYKYYGMAV (SEQ ID NO: 43) |
| 4E4.2, 01, 01A, 01B, 01C, 01D, 01E, 01F, 01G, 02, 02A, 02B, 05, 06, 08, 12, 13, 14, 15 | HV-02 | QVQLVESGGGVVQPGRSLRLS CAASGFTFSSFGMHWVRQAPG KGLEWVAVISFDGSIKYSVDS VKGRFTISRDNSKNTLFLQMN SLRAEDTAVYYCARDRLNYY ESSGYYHYKYYGMAVWGQG TTVTVSS (SEQ ID NO: 48) | SFGMH (SEQ ID NO: 35) | VISFDGSIKYS VDSVKG (SEQ ID NO: 39) | DRLNYYESSGYY HYKYYGMAV (SEQ ID NO: 44) |
| 03, 03A, 03B, 04 | HV-03 | QVQLVESGGGVVQPGRSLRLS CAASGFTFSSFGMHWVRQAPG KGLEWVAVISFDGSIKYSVDS VKGRFTISRDNSKNTLFLQMN SLRAEDTAVYYCARDRLNYY RSFGYYGYHYYGMAVWGQG TTVTVSS (SEQ ID NO: 49) | SFGMH (SEQ ID NO: 35) | VISFDGSIKYS VDSVKG (SEQ ID NO: 39) | DRLNYYRSFGYY GYHYYGMAV (SEQ ID NO: 45) |
| 07 | HV-04 | QVQLVESGGGVVQPGRSLRLS CAASGFYFMTYGMHWVRQAP GKGLEWVAVISFDGSIKYSVD SVKGRFTISRDNSKNTLFLQM NSLRAEDTAVYYCARDRLNY YESSGYYHYKYYGMAVWGQ GTTVTVSS (SEQ ID NO: 50) | TYGMH (SEQ ID NO: 36) | VISFDGSIKYS VDSVKG (SEQ ID NO: 39) | DRLNYYESSGYY HYKYYGMAV (SEQ ID NO: 44) |
| 09 | HV-05 | QVQLVESGGGVVQPGRSLRLS CAASGFTFSSFGMHWVRQAPG KGLEWVAVISFAGEIDYYVDS VKGRFTISRDNSKNTLFLQMN SLRAEDTAVYYCARDRLNYY ESSGYYHYKYYGMAVWGQG TTVTVSS (SEQ ID NO: 51) | SFGMH (SEQ ID NO: 35) | VISFAGEIDY YVDSVKG (SEQ ID NO: 40) | DRLNYYESSGYY HYKYYGMAV (SEQ ID NO: 44) |

TABLE 2B-continued

Exemplary Anti-Human CGRP Receptor Antibody Heavy Chain Variable Region Amino Acid Sequences

| Antibody ID. | VH Group | VH Amino Acid Sequence | CDRH1 | CDRH2 | CDRH3 |
|---|---|---|---|---|---|
| 10 | HV-06 | QVQLVESGGGVVQPGRSLRLS CAASGFFFGSYGMHWVRQAP GKGLEWVAVISFAGEIEHYVD SVKGRFTISRDNSKNTLFLQM NSLRAEDTAVYYCARDRLNY YESSGYYHYKYYGMAVWGQ GTTVTVSS (SEQ ID NO: 52) | SYGMH (SEQ ID NO: 37) | VISFAGEIEH YVDSVKG (SEQ ID NO: 41) | DRLNYYESSGYY HYKYYGMAV (SEQ ID NO: 44) |
| 11 | HV-07 | QVQLVESGGGVVQPGRSLRLS CAASGFWFDTFGMHWVRQAP GKGLEWVAVISFAGEDTHYV DSVKGRFTISRDNSKNTLFLQ MNSLRAEDTAVYYCARDRLN YYESYGYYGYHYYGMAVWG QGTTVTVSS (SEQ ID NO: 53) | TFGMH (SEQ ID NO: 38) | VISFAGEDTH YVDSVKG (SEQ ID NO: 42) | DRLNYYESYGYY GYHYYGMAV (SEQ ID NO: 46) |

The anti-CGRP receptor antibodies, antigen-binding fragments, antigen binding proteins or binding domains thereof of the invention may comprise one or more of the light chain CDRs (i.e. CDRLs) and/or heavy chain CDRs (i.e. CDRHs) presented in Tables 2A and 2B, respectively. For instance, in some embodiments, the anti-CGRP receptor antibodies, antigen-binding fragments, antigen binding proteins or binding domains thereof of the invention comprise a CDRL1 comprising a sequence selected from SEQ ID NOs: 5 to 12; a CDRL2 comprising a sequence selected from SEQ ID NOs: 13 to 16; a CDRL3 comprising a sequence selected from SEQ ID NOs: 17 to 22; a CDRH1 comprising a sequence selected from SEQ ID NOs: 35 to 38; a CDRH2 comprising a sequence selected from SEQ ID NOs: 39 to 42; and a CDRH3 comprising a sequence selected from SEQ ID NOs: 44 to 46.

In some embodiments, the anti-CGRP receptor antibodies, antigen-binding fragments, antigen binding proteins or binding domains thereof of the invention comprise a light chain variable region comprising a CDRL1, a CDRL2, and a CDRL3, wherein: (a) CDRL1, CDRL2, and CDRL3 have the sequence of SEQ ID NOs: 6, 13 and 17, respectively; (b) CDRL1, CDRL2, and CDRL3 have the sequence of SEQ ID NOs: 7, 13 and 17, respectively; (c) CDRL1, CDRL2, and CDRL3 have the sequence of SEQ ID NOs: 5, 13 and 17, respectively; (d) CDRL1, CDRL2, and CDRL3 have the sequence of SEQ ID NOs: 8, 14 and 18, respectively; (e) CDRL1, CDRL2, and CDRL3 have the sequence of SEQ ID NOs: 9, 13 and 17, respectively; (f) CDRL1, CDRL2, and CDRL3 have the sequence of SEQ ID NOs: 10, 13 and 17, respectively; (g) CDRL1, CDRL2, and CDRL3 have the sequence of SEQ ID NOs: 11, 15 and 19, respectively; (h) CDRL1, CDRL2, and CDRL3 have the sequence of SEQ ID NOs: 11, 16 and 20, respectively; (i) CDRL1, CDRL2, and CDRL3 have the sequence of SEQ ID NOs: 12, 13 and 17, respectively; (j) CDRL1, CDRL2, and CDRL3 have the sequence of SEQ ID NOs: 5, 13 and 21, respectively; or (k) CDRL1, CDRL2, and CDRL3 have the sequence of SEQ ID NOs: 5, 13 and 22, respectively. In these and other embodiments, the anti-CGRP receptor antibodies, antigen-binding fragments, antigen binding proteins or binding domains thereof of the invention comprise a heavy chain variable region comprising a CDRH1, a CDRH2, and a CDRH3, wherein: (a) CDRH1, CDRH2, and CDRH3 have the sequence of SEQ ID NOs: 35, 39 and 44, respectively; (b) CDRH1, CDRH2, and CDRH3 have the sequence of SEQ ID NOs: 35, 39 and 45, respectively; (c) CDRH1, CDRH2, and CDRH3 have the sequence of SEQ ID NOs: 36, 39 and 44, respectively; (d) CDRH1, CDRH2, and CDRH3 have the sequence of SEQ ID NOs: 35, 40 and 44, respectively; (e) CDRH1, CDRH2, and CDRH3 have the sequence of SEQ ID NOs: 37, 41 and 44, respectively; or (f) CDRH1, CDRH2, and CDRH3 have the sequence of SEQ ID NOs: 38, 42 and 46, respectively.

In certain embodiments, the anti-CGRP receptor antibodies, antigen-binding fragments, antigen binding proteins or binding domains thereof of the invention comprise a light chain variable region comprising a CDRL1, a CDRL2, and a CDRL3 and a heavy chain variable region comprising a CDRH1, a CDRH2, and a CDRH3, wherein:

(a) CDRL1, CDRL2, and CDRL3 have the sequence of SEQ ID NOs: 6, 13 and 17, respectively, and CDRH1, CDRH2, and CDRH3 have the sequence of SEQ ID NOs: 35, 39 and 44, respectively;

(b) CDRL1, CDRL2, and CDRL3 have the sequence of SEQ ID NOs: 7, 13 and 17, respectively, and CDRH1, CDRH2, and CDRH3 have the sequence of SEQ ID NOs: 35, 39 and 44, respectively;

(c) CDRL1, CDRL2, and CDRL3 have the sequence of SEQ ID NOs: 5, 13 and 17, respectively, and CDRH1, CDRH2, and CDRH3 have the sequence of SEQ ID NOs: 35, 39 and 45, respectively;

(d) CDRL1, CDRL2, and CDRL3 have the sequence of SEQ ID NOs: 8, 14 and 18, respectively, and CDRH1, CDRH2, and CDRH3 have the sequence of SEQ ID NOs: 35, 39 and 44, respectively;

(e) CDRL1, CDRL2, and CDRL3 have the sequence of SEQ ID NOs: 9, 13 and 17, respectively, and CDRH1, CDRH2, and CDRH3 have the sequence of SEQ ID NOs: 35, 39 and 44, respectively;

(f) CDRL1, CDRL2, and CDRL3 have the sequence of SEQ ID NOs: 5, 13 and 17, respectively, and CDRH1, CDRH2, and CDRH3 have the sequence of SEQ ID NOs: 36, 39 and 44, respectively;

(g) CDRL1, CDRL2, and CDRL3 have the sequence of SEQ ID NOs: 10, 13 and 17, respectively, and CDRH1, CDRH2, and CDRH3 have the sequence of SEQ ID NOs: 35, 39 and 44, respectively;

(h) CDRL1, CDRL2, and CDRL3 have the sequence of SEQ ID NOs: 5, 13 and 17, respectively, and CDRH1, CDRH2, and CDRH3 have the sequence of SEQ ID NOs: 35, 40 and 44, respectively;

(i) CDRL1, CDRL2, and CDRL3 have the sequence of SEQ ID NOs: 5, 13 and 17, respectively, and CDRH1, CDRH2, and CDRH3 have the sequence of SEQ ID NOs: 37, 41 and 44, respectively;

(j) CDRL1, CDRL2, and CDRL3 have the sequence of SEQ ID NOs: 11, 15 and 19, respectively, and CDRH1, CDRH2, and CDRH3 have the sequence of SEQ ID NOs: 38, 42 and 46, respectively;

(k) CDRL1, CDRL2, and CDRL3 have the sequence of SEQ ID NOs: 11, 16 and 20, respectively, and CDRH1, CDRH2, and CDRH3 have the sequence of SEQ ID NOs: 35, 39 and 44, respectively;

(l) CDRL1, CDRL2, and CDRL3 have the sequence of SEQ ID NOs: 12, 13 and 17, respectively, and CDRH1, CDRH2, and CDRH3 have the sequence of SEQ ID NOs: 35, 39 and 44, respectively;

(m) CDRL1, CDRL2, and CDRL3 have the sequence of SEQ ID NOs: 5, 13 and 21, respectively, and CDRH1, CDRH2, and CDRH3 have the sequence of SEQ ID NOs: 35, 39 and 44, respectively; or (n) CDRL1, CDRL2, and CDRL3 have the sequence of SEQ ID NOs: 5, 13 and 22, respectively, and CDRH1, CDRH2, and CDRH3 have the sequence of SEQ ID NOs: 35, 39 and 44, respectively.

In one embodiment, the anti-CGRP receptor antibody, antigen-binding fragment, antigen binding protein or binding domain thereof comprises a light chain variable region comprising a CDRL1, a CDRL2, and a CDRL3 and a heavy chain variable region comprising a CDRH1, a CDRH2, and a CDRH3, wherein CDRL1, CDRL2, and CDRL3 have the sequence of SEQ ID NOs: 6, 13 and 17, respectively, and CDRH1, CDRH2, and CDRH3 have the sequence of SEQ ID NOs: 35, 39 and 44, respectively. In another embodiment, the anti-CGRP receptor antibody, antigen-binding fragment, antigen binding protein or binding domain thereof comprises a light chain variable region comprising a CDRL1, a CDRL2, and a CDRL3 and a heavy chain variable region comprising a CDRH1, a CDRH2, and a CDRH3, wherein CDRL1, CDRL2, and CDRL3 have the sequence of SEQ ID NOs: 7, 13 and 17, respectively, and CDRH1, CDRH2, and CDRH3 have the sequence of SEQ ID NOs: 35, 39 and 44, respectively. In yet another embodiment, the anti-CGRP receptor antibody, antigen-binding fragment, antigen binding protein or binding domain thereof comprises a light chain variable region comprising a CDRL1, a CDRL2, and a CDRL3 and a heavy chain variable region comprising a CDRH1, a CDRH2, and a CDRH3, wherein CDRL1, CDRL2, and CDRL3 have the sequence of SEQ ID NOs: 5, 13 and 17, respectively, and CDRH1, CDRH2, and CDRH3 have the sequence of SEQ ID NOs: 35, 39 and 45, respectively. In still another embodiment, the anti-CGRP receptor antibody, antigen-binding fragment, antigen binding protein or binding domain thereof comprises a light chain variable region comprising a CDRL1, a CDRL2, and a CDRL3 and a heavy chain variable region comprising a CDRH1, a CDRH2, and a CDRH3, wherein CDRL1, CDRL2, and CDRL3 have the sequence of SEQ ID NOs: 8, 14 and 18, respectively, and CDRH1, CDRH2, and CDRH3 have the sequence of SEQ ID NOs: 35, 39 and 44, respectively. In one particular embodiment, the anti-CGRP receptor antibody, antigen-binding fragment, antigen binding protein or binding domain thereof comprises a light chain variable region comprising a CDRL1, a CDRL2, and a CDRL3 and a heavy chain variable region comprising a CDRH1, a CDRH2, and a CDRH3, wherein CDRL1, CDRL2, and CDRL3 have the sequence of SEQ ID NOs: 9, 13 and 17, respectively, and CDRH1, CDRH2, and CDRH3 have the sequence of SEQ ID NOs: 35, 39 and 44, respectively.

In some embodiments, the anti-CGRP receptor antibodies, antigen-binding fragments, antigen binding proteins or binding domains thereof of the invention may comprise CDRs having sequences according to consensus CDR sequences generated from sequence alignments of CDR sequences from anti-CGRP receptor antibodies having enhanced inhibitory potency (see Example 1) or predicted from the analysis of the structure of the paratope/epitope interface (see Example 5). For instance, in certain embodiments, the anti-CGRP receptor antibodies, antigen-binding fragments, antigen binding proteins or binding domains thereof of the invention comprise a heavy chain variable region comprising a CDRH1, a CDRH2, and a CDRH3, wherein CDRH1 comprises a sequence according to a CDRH1 consensus sequence, CDRH2 comprises a sequence according to a CDRH2 consensus sequence, and CDRH3 comprises a sequence according to a CDRH3 consensus sequence. In one embodiment, the CDRH1 consensus sequence is $X_1FX_2X_3X_4GMH$ (SEQ ID NO: 471), where $X_1$ is N, K, R, H, F, W, or Y; $X_2$ is S, G, D, or M; $X_3$ is S, T, N, K, R, or H; and $X_4$ is F or Y. In another embodiment, the CDRH1 consensus sequence is $X_1FSX_2FGMH$ (SEQ ID NO: 472), where $X_1$ is N, K, R, or H and $X_2$ is S, T, N, K, R, or H. In related embodiments, the CDRH2 consensus sequence is $VISFX_1GX_2X_3X_4X_5X_6VDSVKG$ (SEQ ID NO: 473), where $X_1$ is D or A; $X_2$ is S or E; $X_3$ is I or D; $X_4$ is K, E, T, or D; $X_5$ is Y or H; and $X_6$ is S or Y. In other related embodiments, the CDRH3 consensus sequence is $DRLX_1YYX_2SX_3GYYX_4YX_5YYGMAV$ (SEQ ID NO: 474), where $X_1$ is N, D, or E; $X_2$ is D, E, or R; $X_3$ is S, Y, or F; $X_4$ is G or H; and $X_5$ is K or H.

In certain embodiments, the anti-CGRP receptor antibodies, antigen-binding fragments, antigen binding proteins or binding domains thereof of the invention comprise a light chain variable region comprising a CDRL1, a CDRL2, and a CDRL3, wherein CDRL1 comprises a sequence according to a CDRL1 consensus sequence, CDRL2 comprises a sequence according to a CDRL2 consensus sequence, and CDRL3 comprises a sequence according to a CDRL3 consensus sequence. In such embodiments, the CDRL1 consensus sequence may be $SGSX_1SNIGX_2X_3X_4VS$ (SEQ ID NO: 475), where $X_1$ is F, R, Y, or S; $X_2$ is N, R, I, or W; $X_3$ is N, S, Y, R, K, or W; and $X_4$ is Y, T, S, A, or P. In related embodiments, the CDRL2 consensus sequence is $DNX_1X_2RX_3X_4$ (SEQ ID NO: 476), where $X_1$ is N, R, or M; $X_2$ is K, W, F, or Y; $X_3$ is P or A; and $X_4$ is S, G, R, or Q. In still other related embodiments, the CDRL3 consensus sequence may be $GTWDX_1X_2X_3X_4X_5VX_6$ (SEQ ID NO: 477), where $X_1$ is S, Y, or W; $X_2$ is R, Q, A, or W; $X_3$ is L, W, M, T, H, or R; $X_4$ is S, K, Q, T, or R; $X_5$ is A, S, or V; and $X_6$ is V, T, or I.

In some embodiments, the anti-CGRP receptor antibodies, antigen-binding fragments, antigen binding proteins or binding domains thereof of the invention comprise an immunoglobulin heavy chain variable region (VH) and an immunoglobulin light chain variable region (VL) from an antibody that specifically binds to human CGRP receptor, such as the antibodies described herein. The "variable region," used interchangeably herein with "variable domain" (variable region of a light chain (VL), variable region of a heavy chain (VH)), refers to the region in each of the light and heavy immunoglobulin chains which is involved directly in binding the antibody to the antigen. As discussed above, the regions of variable light and heavy chains have the same general structure and each region comprises four framework (FR) regions, the sequences of which are widely conserved, connected by three CDRs. The framework regions adopt a beta-sheet conformation and the CDRs may form loops connecting the beta-sheet structure. The CDRs in each chain are held in their three-dimensional structure by the framework regions and form, together with the CDRs from the other chain, the antigen binding site. Thus, in some embodiments, the anti-CGRP receptor antibodies, antigen-binding fragments, antigen binding proteins or binding domains thereof of the invention may comprise a light chain variable region selected from LV-01 to LV-12, as shown in Table 2A, and/or a heavy chain variable region selected from HV-01 to HV-07, as shown in Table 2B, and binding fragments, derivatives, and variants of these light chain and heavy chain variable regions.

Each of the light chain variable regions listed in Table 2A may be combined with any of the heavy chain variable regions listed in Table 2B to form an anti-CGRP antibody or antigen-binding fragment thereof of the invention or an anti-CGRP receptor binding domain of a bispecific antigen binding protein of the invention. Examples of such combinations include, but are not limited to: (i) LV-03 and HV-02; (ii) LV-04 and HV-02; (iii) LV-01 and HV-03; (iv) LV-02 and any one of HV-03, HV-04, HV-05, and HV-06; (v) LV-05 and HV-02; (vi) LV-06 and HV-02; (vii) LV-07 and HV-02; (viii) LV-08 and HV-07; (ix) LV-09 and HV-02; (x) LV-10 and HV-02; (xi) LV-11 and HV-02; and (xii) LV-12 and HV-02.

In certain embodiments, the anti-CGRP receptor antibodies, antigen-binding fragments, antigen binding proteins or binding domains thereof of the invention comprise a light chain variable region comprising the sequence of SEQ ID NO: 25 and a heavy chain variable region comprising the sequence of SEQ ID NO: 48. In some embodiments, the anti-CGRP receptor antibodies, antigen-binding fragments, antigen binding proteins or binding domains thereof of the invention comprise a light chain variable region comprising the sequence of SEQ ID NO: 26 and a heavy chain variable region comprising the sequence of SEQ ID NO: 48. In other embodiments, the anti-CGRP receptor antibodies, antigen-binding fragments, antigen binding proteins or binding domains thereof of the invention comprise a light chain variable region comprising the sequence of SEQ ID NO: 23 and a heavy chain variable region comprising the sequence of SEQ ID NO: 49. In still other embodiments, the anti-CGRP receptor antibodies, antigen-binding fragments, antigen binding proteins or binding domains thereof of the invention comprise a light chain variable region comprising the sequence of SEQ ID NO: 24 and a heavy chain variable region comprising the sequence of SEQ ID NO: 49. In some embodiments, the anti-CGRP receptor antibodies, antigen-binding fragments, antigen binding proteins or binding domains thereof of the invention comprise a light chain variable region comprising the sequence of SEQ ID NO: 27 and a heavy chain variable region comprising the sequence of SEQ ID NO: 48. In certain embodiments, the anti-CGRP receptor antibodies, antigen-binding fragments, antigen binding proteins or binding domains thereof of the invention comprise a light chain variable region comprising the sequence of SEQ ID NO: 28 and a heavy chain variable region comprising the sequence of SEQ ID NO: 48.

In one embodiment, the anti-CGRP receptor antibodies, antigen-binding fragments, antigen binding proteins or binding domains thereof of the invention comprise a light chain variable region comprising the sequence of SEQ ID NO: 24 and a heavy chain variable region comprising the sequence of SEQ ID NO: 50. In another embodiment, the anti-CGRP receptor antibodies, antigen-binding fragments, antigen binding proteins or binding domains thereof of the invention comprise a light chain variable region comprising the sequence of SEQ ID NO: 29 and a heavy chain variable region comprising the sequence of SEQ ID NO: 48. In yet another embodiment, the anti-CGRP receptor antibodies, antigen-binding fragments, antigen binding proteins or binding domains thereof of the invention comprise a light chain variable region comprising the sequence of SEQ ID NO: 24 and a heavy chain variable region comprising the sequence of SEQ ID NO: 51. In still another embodiment, the anti-CGRP receptor antibodies, antigen-binding fragments, antigen binding proteins or binding domains thereof of the invention comprise a light chain variable region comprising the sequence of SEQ ID NO: 24 and a heavy chain variable region comprising the sequence of SEQ ID NO: 52. In one particular embodiment, the anti-CGRP receptor antibodies, antigen-binding fragments, antigen binding proteins or binding domains thereof of the invention comprise a light chain variable region comprising the sequence of SEQ ID NO: 30 and a heavy chain variable region comprising the sequence of SEQ ID NO: 53. In another particular embodiment, the anti-CGRP receptor antibodies, antigen-binding fragments, antigen binding proteins or binding domains thereof of the invention comprise a light chain variable region comprising the sequence of SEQ ID NO: 31 and a heavy chain variable region comprising the sequence of SEQ ID NO: 48. In certain embodiments, the anti-CGRP receptor antibodies, antigen-binding fragments, antigen binding proteins or binding domains thereof of the invention comprise a light chain variable region comprising the sequence of SEQ ID NO: 32 and a heavy chain variable region comprising the sequence of SEQ ID NO: 48. In some embodiments, the anti-CGRP receptor antibodies, antigen-binding fragments, antigen binding proteins or binding domains thereof of the invention comprise a light chain variable region comprising the sequence of SEQ ID NO: 33 and a heavy chain variable region comprising the sequence of SEQ ID NO: 48. In other embodiments, the anti-CGRP receptor antibodies, antigen-binding fragments, antigen binding proteins or binding domains thereof of the invention comprise a light chain variable region comprising the sequence of SEQ ID NO: 34 and a heavy chain variable region comprising the sequence of SEQ ID NO: 48.

In some embodiments, the anti-CGRP receptor antibodies, antigen-binding fragments, antigen binding proteins or binding domains thereof comprise a light chain variable region comprising a sequence of contiguous amino acids that differs from the sequence of a light chain variable region in Table 2A, i.e. a VL selected from LV-01 to LV-12, at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The light chain variable region in some anti-CGRP receptor antibodies, binding fragments, antigen binding proteins or binding domains thereof comprises a sequence of amino acids that has at least 70%, at least 75%, at least 80%, at least 85%, at least 90%, at least 95%, at least 97% or at least 99% sequence identity to the amino acid sequences of SEQ ID NOs: 23 to 34 (i.e. the light chain variable regions in Table 2A).

In one embodiment, the anti-CGRP receptor antibody, antigen-binding fragment, antigen binding protein, or binding domain thereof comprises a light chain variable region comprising a sequence that is at least 90% identical to a sequence selected from SEQ ID NOs: 23-34. In another embodiment, the anti-CGRP receptor antibody, antigen-binding fragment, antigen binding protein, or binding domain thereof comprises a light chain variable region comprising a sequence that is at least 95% identical to a sequence selected from SEQ ID NOs: 23-34. In yet another embodiment, the anti-CGRP receptor antibody, antigen-binding fragment, antigen binding protein, or binding domain thereof comprises a light chain variable region comprising a sequence selected from SEQ ID NOs: 23-34. In some embodiments, the anti-CGRP receptor antibody, antigen-binding fragment, antigen binding protein, or binding domain thereof comprises a light chain variable region comprising the sequence of SEQ ID NO: 25. In other embodiments, the anti-CGRP receptor antibody, antigen-binding fragment, antigen binding protein, or binding domain thereof comprises a light chain variable region comprising the sequence of SEQ ID NO: 26. In yet other embodiments, the anti-CGRP receptor antibody, antigen-binding fragment, antigen binding protein, or binding domain thereof comprises a light chain variable region comprising the sequence of SEQ ID NO: 24. In still other embodiments, the anti-CGRP receptor antibody, antigen-binding fragment, antigen binding protein, or binding domain thereof comprises a light chain variable region comprising the sequence of SEQ ID NO: 27. In one particular embodiment, the anti-CGRP receptor antibody, antigen-binding fragment, antigen binding protein, or binding domain thereof comprises a light chain variable region comprising the sequence of SEQ ID NO: 28. In another particular embodiment, the anti-CGRP receptor antibody, antigen-binding fragment, antigen binding protein, or binding domain thereof comprises a light chain variable region comprising the sequence of SEQ ID NO: 23.

In these and other embodiments, the anti-CGRP receptor antibodies, antigen-binding fragments, antigen binding proteins or binding domains thereof comprise a heavy chain variable region comprising a sequence of contiguous amino acids that differs from the sequence of a heavy chain variable region in Table 2B, i.e., a VH selected from HV-01 to HV-07, at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The heavy chain variable region in some anti-CGRP receptor antibodies, antigen-binding fragments, antigen binding proteins or binding domains thereof comprises a sequence of amino acids that has at least 70%, at least 75%, at least 80%, at least 85%, at least 90%, at least 95%, at least 97% or at least 99% sequence identity to the amino acid sequences of SEQ ID NOs: 47 to 53 (i.e. the heavy chain variable regions in Table 2B).

In one embodiment, the anti-CGRP receptor antibody, antigen-binding fragment, antigen binding protein, or binding domain thereof comprises a heavy chain variable region comprising a sequence that is at least 90% identical to a sequence selected from SEQ ID NOs: 48-53. In another embodiment, the anti-CGRP receptor antibody, antigen-binding fragment, antigen binding protein, or binding domain thereof comprises a heavy chain variable region comprising a sequence that is at least 95% identical to a sequence selected from SEQ ID NOs: 48-53. In yet another embodiment, the anti-CGRP receptor antibody, antigen-binding fragment, antigen binding protein, or binding domain thereof comprises a heavy chain variable region comprising a sequence selected from SEQ ID NOs: 48-53. In some embodiments, the anti-CGRP receptor antibody, antigen-binding fragment, antigen binding protein, or binding domain thereof comprises a heavy chain variable region comprising the sequence of SEQ ID NO: 48. In other embodiments, the anti-CGRP receptor antibody, antigen-binding fragment, antigen binding protein, or binding domain thereof comprises a heavy chain variable region comprising the sequence of SEQ ID NO: 49. In yet other embodiments, the anti-CGRP receptor antibody, antigen-binding fragment, antigen binding protein, or binding domain thereof comprises a heavy chain variable region comprising the sequence of SEQ ID NO: 50. In still other embodiments, the anti-CGRP receptor antibody, antigen-binding fragment, antigen binding protein, or binding domain thereof comprises a heavy chain variable region comprising the sequence of SEQ ID NO: 51. In certain embodiments, the anti-CGRP receptor antibody, antigen-binding fragment, antigen binding protein, or binding domain thereof comprises a heavy chain variable region comprising the sequence of SEQ ID NO: 52. In other embodiments, the anti-CGRP receptor antibody, antigen-binding fragment, antigen binding protein, or binding domain thereof comprises a heavy chain variable region comprising the sequence of SEQ ID NO: 53.

The term "identity," as used herein, refers to a relationship between the sequences of two or more polypeptide molecules or two or more nucleic acid molecules, as determined by aligning and comparing the sequences. "Percent identity," as used herein, means the percent of identical residues between the amino acids or nucleotides in the compared molecules and is calculated based on the size of the smallest of the molecules being compared. For these calculations, gaps in alignments (if any) must be addressed by a particular mathematical model or computer program (i.e., an "algorithm"). Methods that can be used to calculate the identity of the aligned nucleic acids or polypeptides include those described in Computational Molecular Biology, (Lesk, A. M., ed.), 1988, New York: Oxford University Press; Biocomputing Informatics and Genome Projects, (Smith, D. W., ed.), 1993, New York: Academic Press; Computer Analysis of Sequence Data, Part I, (Griffin, A. M., and Griffin, H. G., eds.), 1994, New Jersey: Humana Press; von Heinje, G., 1987, Sequence Analysis in Molecular Biology, New York: Academic Press; Sequence Analysis Primer, (Gribskov, M. and Devereux, J., eds.), 1991, New York: M. Stockton Press; and Carillo et al., 1988, SIAM J. Applied Math. 48:1073. For example, sequence identity can be determined by standard methods that are commonly used to compare the similarity in position of the amino acids of two polypeptides. Using a computer program such as BLAST or FASTA, two polypeptide or two polynucleotide sequences are aligned for optimal matching of their respective residues (either along the full length of one or both sequences, or along a predetermined portion of one or both sequences). The programs provide a default opening penalty and a default gap penalty, and a scoring matrix such as PAM 250 (Dayhoff et al., in Atlas of Protein Sequence and Structure, vol. 5, supp. 3, 1978) or BLOSUM62 (Henikoff et al., 1992, Proc. Natl. Acad. Sci. U.S.A. 89:10915-10919) can be used in conjunction with the computer program. For example, the percent identity can then be calculated as: the total number of identical matches multiplied by 100 and then divided by the sum of the length of the longer sequence within the matched span and the number of gaps introduced into the longer sequences in order to align the two sequences. In calculating percent identity, the sequences being compared are aligned in a way that gives the largest match between the sequences.

The GCG program package is a computer program that can be used to determine percent identity, which package includes GAP (Devereux et al., 1984, Nucl. Acid Res. 12:387; Genetics Computer Group, University of Wisconsin, Madison, WI). The computer algorithm GAP is used to align the two polypeptides or two polynucleotides for which the percent sequence identity is to be determined. The sequences are aligned for optimal matching of their respective amino acid or nucleotide (the "matched span," as determined by the algorithm). A gap opening penalty (which is calculated as 3× the average diagonal, wherein the "average diagonal" is the average of the diagonal of the comparison matrix being used; the "diagonal" is the score or number assigned to each perfect amino acid match by the particular comparison matrix) and a gap extension penalty (which is usually 1/10 times the gap opening penalty), as well as a comparison matrix such as PAM 250 or BLOSUM 62 are used in conjunction with the algorithm. In certain embodiments, a standard comparison matrix (see, Dayhoff et al., 1978, Atlas of Protein Sequence and Structure 5:345-352 for the PAM 250 comparison matrix; Henikoff et al., 1992, Proc. Natl. Acad. Sci. U.S.A. 89:10915-10919 for the BLOSUM 62 comparison matrix) is also used by the algorithm.

Recommended parameters for determining percent identity for polypeptides or nucleotide sequences using the GAP program include the following:

Algorithm: Needleman et al. 1970, J. Mol. Biol. 48:443-453;

Comparison matrix: BLOSUM 62 from Henikoff et al., 1992, supra;

Gap Penalty: 12 (but with no penalty for end gaps)

Gap Length Penalty: 4

Threshold of Similarity: 0

Certain alignment schemes for aligning two amino acid sequences may result in matching of only a short region of the two sequences, and this small aligned region may have very high sequence identity even though there is no significant relationship between the two full-length sequences. Accordingly, the selected alignment method (GAP program) can be adjusted if so desired to result in an alignment that spans at least 50 contiguous amino acids of the target polypeptide.

The anti-CGRP receptor antibodies or antigen binding proteins of the invention can comprise any immunoglobulin constant region. The term "constant region," used interchangeably herein with "constant domain" refers to all domains of an antibody other than the variable region. The constant region is not involved directly in binding of an antigen, but exhibits various effector functions. As described above, antibodies are divided into particular isotypes (IgA, IgD, IgE, IgG, and IgM) and subtypes (IgG1, IgG2, IgG3, IgG4, IgA1 IgA2) depending on the amino acid sequence of the constant region of their heavy chains. The light chain constant region can be, for example, a kappa- or lambda-type light chain constant region, e.g., a human kappa- or lambda-type light chain constant region, which are found in all five antibody isotypes. Examples of human immunoglobulin light chain constant region amino acid sequences are shown in the following table.

TABLE 3

Exemplary Human Immunoglobulin Light Chain Constant Regions

| Designation | SEQ ID NO: | CL Domain Amino Acid Sequence |
|---|---|---|
| Human lambda v1 | 54 | GQPKANPTVTLFPPSSEELQAN KATLVCLISDFYPGAVTVAWKA DGSPVKAGVETTKPSKQSNNKY AASSYLSLTPEQWKSHRSYSC QVTHEGSTVEKTVAPTECS |
| Human lambda v2 | 55 | GQPKAAPSVTLFPPSSEELQAN KATLVCLISDFYPGAVTVAWKA DSSPVKAGVETTTPSKQSNNKY AASSYLSLTPEQWKSHRSYSCQ VTHEGSTVEKTVAPTECS |
| Human lambda v3 | 56 | QPKAAPSVTLFPPSSEELQANK ATLVCLISDFYPGAVTVAWKAD SSPVKAGVETTTPSKQSNNKYA ASSYLSLTPEQWKSHRSYSCQV THEGSTVEKTVAPTECS |
| Human lambda v4 | 57 | GQPKAAPSVTLFPPSSEELQAN KATLVCLISDFYPGAVTVAWKA DSSPVKAGVETTTPSKQSNNKY AASSYLSLTPEQWKSHKSYSCQ VTHEGSTVEKTVAPTECS |
| Human lambda v5 | 58 | GQPKAAPSVTLFPPSSEELQAN KATLVCLVSDFYPGAVTVAWK ADGSPVKVGVETTKPSKQSNNK YAASSYLSLTPEQWKSHRSYS CRVTHEGSTVEKTVAPAECS |
| Human kappa v1 | 59 | TVAAPSVFIFPPSDEQLKSGTA SVVCLLNNFYPREAKVQWKVDN ALQSGNSQESVTEQDSKDSTYS LSSTLTLSKADYEKHKVYACEV THQGLSSPVTKSFNRGEC |
| Human kappa v2 | 60 | RTVAAPSVFIFPPSDEQLKSGT ASVVCLLNNFYPREAKVQWKVD NALQSGNSQESVTEQDSKDSTY SLSSTLTLSKADYEKHKVYACE VTHQGLSSPVTKSFNRGEC |

The heavy chain constant region of the anti-CGRP receptor antibodies or antigen binding proteins of the invention can be, for example, an alpha-, delta-, epsilon-, gamma-, or mu-type heavy chain constant region, e.g., a human alpha-, delta-, epsilon-, gamma-, or mu-type heavy chain constant region. In some embodiments, the anti-CGRP receptor antibodies or antigen binding proteins comprise a heavy chain constant region from an IgG1, IgG2, IgG3, or IgG4 immunoglobulin, such as a human IgG1, IgG2, IgG3, or IgG4 immunoglobulin. In one embodiment, the anti-CGRP receptor antibody or antigen binding protein comprises a heavy chain constant region from a human IgG1 immunoglobulin. In such embodiments, the human IgG1 immunoglobulin constant region may comprise one or more mutations to prevent glycosylation of the antibody or antigen binding protein as described in more detail herein. In another embodiment, the anti-CGRP receptor antibody or antigen binding protein comprises a heavy chain constant region from a human IgG2 immunoglobulin. In yet another embodiment, the anti-CGRP receptor antibody or antigen binding protein comprises a heavy chain constant region from a human IgG4 immunoglobulin. Examples of human IgG1, IgG2, and IgG4 heavy chain constant region amino acid sequences are shown below in Table 4.

TABLE 4

Exemplary Human Immunoglobulin Heavy Chain Constant Regions

| Ig isotype | SEQ ID NO: | Heavy Chain Constant Region Amino Acid Sequence |
|---|---|---|
| Human IgG1z | 61 | ASTKGPSVFPLAPSSKSTSGGTAAL<br>GCLVKDYFPEPVTVSWNSGALTSGV<br>HTFPAVLQSSGLYSLSSVVTVPSSS<br>LGTQTYICNVNHKPSNTKVDKKVEP<br>KSCDKTHTCPPCPAPELLGGPSVFL<br>FPPKPKDTLMISRTPEVTCVVVDVS<br>HEDPEVKFNWYVDGVEVHNAKTKPR<br>EEQYNSTYRVVSVLTVLHQDWLNGK<br>EYKCKVSNKALPAPIEKTISKAKGQ<br>PREPQVYTLPPSREEMTKNQVSLTC<br>LVKGFYPSDIAVEWESNGQPENNYK<br>TTPPVLDSDGSFFLYSKLTVDKSRW<br>QQGNVFSCSVMHEALHNHYTQKSLS<br>LSPGK |
| Human IgG1za | 62 | ASTKGPSVFPLAPSSKSTSGGTAAL<br>GCLVKDYFPEPVTVSWNSGALTSGV<br>HTFPAVLQSSGLYSLSSVVTVPSSS<br>LGTQTYICNVNHKPSNTKVDKKVEP<br>KSCDKTHTCPPCPAPELLGGPSVFL<br>FPPKPKDTLMISRTPEVTCVVVDVS<br>HEDPEVKFNWYVDGVEVHNAKTKPR<br>EEQYNSTYRVVSVLTVLHQDWLNGK<br>EYKCKVSNKALPAPIEKTISKAKGQ<br>PREPQVYTLPPSRDELTKNQVSLTC<br>LVKGFYPSDIAVEWESNGQPENNYK<br>TTPPVLDSDGSFFLYSKLTVDKSRW<br>QQGNVFSCSVMHEALHNHYTQKSLS<br>LSPGK |
| Human IgG1f | 63 | ASTKGPSVFPLAPSSKSTSGGTAAL<br>GCLVKDYFPEPVTVSWNSGALTSGV<br>HTFPAVLQSSGLYSLSSWTVPSSSL<br>GTQTYICNVNHKPSNTKVDKRVEPK<br>SCDKTHTCPPCPAPELLGGPSVFLF<br>PPKPKDTLMISRTPEVTCVVVDVSH<br>EDPEVKFNWYVDGVEVHNAKTKPRE<br>EQYNSTYRVVSVLTVLHQDWLNGKE<br>YKCKVSNKALPAPIEKTISKAKGQP<br>REPQVYTLPPSREEMTKNQVSLTCL<br>VKGFYPSDIAVEWESNGQPENNYKT<br>TPPVLDSDGSFFLYSKLTVDKSRWQ<br>QGNVFSCSVMHEALHNHYTQKSLSL<br>SPGK |
| Human IgG1fa | 64 | ASTKGPSVFPLAPSSKSTSGGTAAL<br>GCLVKDYFPEPVTVSWNSGALTSGV<br>HTFPAVLQSSGLYSLSSVVTVPSSS<br>LGTQTYICNVNHKPSNTKVDKRVEP<br>KSCDKTHTCPPCPAPELLGGPSVFL<br>FPPKPKDTLMISRTPEVTCVVVDVS<br>HEDPEVKFNWYVDGVEVHNAKTKPR<br>EEQYNSTYRVVSVLTVLHQDWLNGK<br>EYKCKVSNKALPAPIEKTISKAKGQ<br>PREPQVYTLPPSRDELTKNQVSLTC<br>LVKGFYPSDIAVEWESNGQPENNYK<br>TTPPVLDSDGSFFLYSKLTVDKSRW<br>QQGNVFSCSVMHEALHNHYTQKSLS<br>LSPGK |
| Human IgG1z aglycosylated v1 | 65 | ASTKGPSVFPLAPSSKSTSGGTAAL<br>GCLVKDYFPEPVTVSWNSGALTSGV<br>HTFPAVLQSSGLYSLSSVVTVPSSS<br>LGTQTYICNVNHKPSNTKVDKKVEP<br>KSCDKTHTCPPCPAPELLGGPSVFL<br>FPPKPKDTLMISRTPEVTCVVVDVS<br>HEDPEVKFNWYVDGVEVHNAKTKPR<br>EEQYGSTYRVVSVLTVLHQDWLNGK<br>EYKCKVSNKALPAPIEKTISKAKGQ<br>PREPQVYTLPPSREEMTKNQVSLTC<br>LVKGFYPSDIAVEWESNGQPENNYK<br>TTPPVLDSDGSFFLYSKLTVDKSRW<br>QQGNVFSCSVMHEALHNHYTQKSLS<br>LSPGK |
| Human IgG1z aglycosylated v2 | 66 | ASTKGPSVFPLAPSSKSTSGGTAAL<br>GCLVKDYFPEPVTVSWNSGALTSGV<br>HTFPAVLQSSGLYSLSSVVTVPSSS<br>LGTQTYICNVNHKPSNTKVDKKVEP<br>KSCDKTHTCPPCPAPELLGGPSVFL<br>FPPKPKDTLMISRTPEVTCVVVDVS<br>HEDPEVKFNWYVDGVEVHNAKTKPC<br>EEQYGSTYRCVSVLTVLHQDWLNGK<br>EYKCKVSNKALPAPIEKTISKAKGQ<br>PREPQVYTLPPSREEMTKNQVSLTC<br>LVKGFYPSDIAVEWESNGQPENNYK<br>TTPPVLDSDGSFFLYSKLTVDKSRW<br>QQGNVFSCSVMHEALHNHYTQKSLS<br>LSPGK |
| Human IgG2 | 67 | ASTKGPSVFPLAPCSRSTSESTAAL<br>GCLVKDYFPEPVTVSWNSGALTSGV<br>HTFPAVLQSSGLYSLSSVVTVPSSN<br>FGTQTYTCNVDHKPSNTKVDKTVER<br>KCCVECPPCPAPPVAGPSVFLFPPK<br>PKDTLMISRTPEVTCVVVDVSHEDP<br>EVQFNWYVDGVEVHNAKTKPREEQF<br>NSTFRVVSVLTVVHQDWLNGKEYKC<br>KVSNKGLPAPIEKTISKTKGQPREP<br>QVYTLPPSREEMTKNQVSLTCLVKG<br>FYPSDIAVEWESNGQPENNYKTTPP<br>MLDSDGSFFLYSKLTVDKSRWQQGN<br>VFSCSVMHEALHNHYTQKSLSLSPG<br>K |
| Human IgG4 | 68 | ASTKGPSVFPLAPCSRSTSESTAAL<br>GCLVKDYFPEPVTVSWNSGALTSGV<br>HTFPAVLQSSGLYSLSSVVTVPSSS<br>LGTKTYTCNVDHKPSNTKVDKRVES<br>KYGPPCPSCPAPEFLGGPSVFLFPP<br>KPKDTLMISRTPEVTCVVVDVSQED<br>PEVQFNWYVDGVEVHNAKTKPREEQ<br>FNSTYRVVSVLTVLHQDWLNGKEYK<br>CKVSNKGLPSSIEKTISKAKGQPRE<br>PQVYTLPPSQEEMTKNQVSLTCLVK<br>GFYPSDIAVEWESNGQPENNYKTTP<br>PVLDSDGSFFLYSRLTVDKSRWQEG<br>NVFSCSVMHEALHNHYTQKSLSLSL<br>GK |

Each of the light chain variable regions disclosed in Table 2A and each of the heavy chain variable regions disclosed in Table 2B may be attached to the above light chain constant regions (Table 3) and heavy chain constant regions (Table 4) to form complete antibody light and heavy chains, respectively. Further, each of the so generated heavy and light chain sequences may be combined to form a complete antibody structure or bispecific antigen binding protein as described in more detail below. It should be understood that the heavy chain and light chain variable regions provided herein can also be attached to other constant domains having different sequences than the exemplary sequences listed above.

The anti-CGRP receptor antibodies or antigen-binding fragments of the invention can be any of the anti-CGRP receptor antibodies or antigen-binding fragments disclosed herein. For example, in certain embodiments, the anti-CGRP receptor antibody or antigen-binding fragment is an anti- CGRP receptor antibody or antigen-binding fragment selected from any of the antibodies listed in Tables 12, 13, and 14 or antigen-binding fragments thereof. In some embodiments, the anti-CGRP receptor antibody or antigen-binding fragment of the invention is selected from antibodies 01, 02, 03, 04, 05, 06, 07, 08, 09, 10, 11, 12, 13, 14, and 15 or antigen-binding fragments thereof, the variable region and CDR sequences of which are set forth in Tables 2A and 2B. In some embodiments, the anti-CGRP receptor antibody is an antibody selected from 01, 02, 03, 04, 05, and 06 antibodies. Full-length light chain and full-length heavy chain sequences of these exemplary human anti-CGRP receptor antibodies are set forth below in Tables 5A and 5B, respectively.

TABLE 5A

Exemplary Anti-CGRP Receptor Antibody Light Chain Sequences

| Antibody ID. | LC Group | Light Chain Amino Acid Sequence | Light Chain Nucleic Acid Sequence |
|---|---|---|---|
| 4E4 | LC-01 | QSVLTQPPSVSAAPGQKVTISC SGSSSNIGNNYVSWYQQLPGT APKLLIYDNNKRPSGIPDRFSG SKSGTSTTLGITGLQTGDEAD YYCGTWDSRLSAVVFGGGTK LTVLGQPKANPTVTLFPPSSEE LQANKATLVCLISDFYPGAVT VAWKADGSPVKAGVETTKPS KQSNNKYAASSYLSLTPEQW KSHRSYSCQVTHEGSTVEKTV APTECS (SEQ ID NO: 69) | CAGTCTGTGTTGACGCAGCCGCCCTCAGTGTCTG CGGCCCCAGGACAGAAGGTCACCATCTCCTGCTC TGGAAGCAGCTCCAACATTGGGAATAATTATGTA TCCTGGTACCAGCAGCTCCCAGGAACAGCCCCCA AACTCCTCATTTATGACAATAATAAGCGACCCTC AGGGATTCCTGACCGATTCTCTGGCTCCAAGTCT GGCACGTCAACCACCCTGGGCATCACCGGACTCC AGACTGGGGACGAGGCCGATTATTACTGCGGAAC ATGGGATAGCCGCCTGAGTGCTGTGGTTTTCGGC GGAGGGACCAAGCTGACCGTCCTAGGTCAGCCCA AGGCCAACCCCACTGTCACTCTGTTCCCGCCCTC CTCTGAGGAGCTCCAAGCCAACAAGGCCACACTA GTGTGTCTGATCAGTGACTTCTACCCGGGAGCTGT GACAGTGGCCTGGAAGGCAGATGGCAGCCCCGTC AAGGCGGGAGTGGAGACCACCAAACCCTCCAAA CAGAGCAACAACAAGTACGCGGCCAGCAGCTACC TGAGCCTGACGCCCGAGCAGTGGAAGTCCCACAG AAGCTACAGCTGCCAGGTCACGCATGAAGGGAGC ACCGTGGAGAAGACAGTGGCCCCTACAGAATG TTCA (SEQ ID NO: 99) |
| 4E4.2, 04, 07, 09, 10 | LC-02 | QSVLTQPPSVSAAPGQKVTISC SGSSSNIGNNYVSWYQQLPGT APKLLIYDNNKRPSGIPDRFSG SKSGTSATLGITGLQTGDEAD YYCGTWDSRLSAVVFGGGTK LTVLGQPKAAPSVTLFPPSSEE LQANKATLVCLISDFYPGAVT VAWKADSSPVKAGVETTTPS KQSNNKYAASSYLSLTPEQW KSHRSYSCQVTHEGSTVEKTV APTECS (SEQ ID NO: 70) | CAGTCTGTGTTGACGCAGCCGCCCTCAGTGTCTGC GGCCCCAGGACAGAAGGTCACCATCTCCTGCTCT GGAAGCAGCTCCAACATTGGGAATAATTATGTAT CCTGGTACCAGCAGCTCCCAGGAACAGCCCCCAA ACTCCTCATTTATGACAATAATAAGCGACCCTCA GGGATTCCTGACCGATTCTCTGGCTCCAAGTCTGG CACGTCAGCCACCCTGGGCATCACCGGACTCCAG ACTGGGGACGAGGCCGATTATTACTGCGGAACAT GGGATAGCCGCCTGAGTGCTGTGGTTTTCGGCGG AGGGACCAAGCTGACCGTCCTAGGTCAGCCCAAG GCTGCACCCTCGGTCACTCTGTTCCCGCCCTCCTC TGAGGAGCTTCAAGCCAACAAGGCCACACTGGTG TGTCTCATCAGTGACTTCTACCCGGGAGCCGTGAC AGTGGCCTGGAAGGCAGATAGCAGCCCCGTCAAG GCGGGAGTGGAAACCACCACACCCTCCAAACAAA GCAACAACAAGTACGCGGCCAGCAGCTATCTGAG CCTGACGCCTGAGCAGTGGAAGTCCCACAGAAGC TACAGCTGCCAGGTCACGCATGAAGGGAGCACCG TGGAGAAGACAGTGGCCCCTACAGAATGTTCA (SEQ ID NO: 100) |
| 01 | LC-03 | QSVLTQPPSVSAAPGQKVTISC SGSYSNIGRYSVSWYQQLPGT APKLLIYDNNKRPSGIPDRFSG SKSGTSATLGITGLQTGDEAD YYCGTWDSRLSAVVFGGGTK LTVLGQPKAAPSVTLFPPSSEE LQANKATLVCLISDFYPGAVT VAWKADSSPVKAGVETTTPS KQSNNKYAASSYLSLTPEQW KSHRSYSCQVTHEGSTVEKTV APTECS (SEQ ID NO: 71) | CAGTCTGTGTTGACGCAGCCGCCCTCAGTGTCTGC GGCCCCAGGACAGAAGGTCACCATCTCCTGCTCT GGAAGCTACTCCAACATTGGGCGTTACTCTGTATC CTGGTACCAGCAGCTCCCAGGAACAGCCCCCAAA CTCCTCATTTATGACAATAATAAGCGACCCTCAG GGATTCCTGACCGATTCTCTGGCTCCAAGTCTGGC ACGTCAGCCACCCTGGGCATCACCGGACTCCAGA CTGGGGACGAGGCCGATTATTACTGCGGAACATG GGATAGCCGCCTGAGTGCTGTGGTTTTCGGCGGA GGGACCAAGCTGACCGTCCTAGGTCAGCCCAAGG CTGCACCCTCGGTCACTCTGTTCCCGCCCTCCTCT GAGGAGCTTCAAGCCAACAAGGCCACACTGGTGT GTCTCATCAGTGACTTCTACCCGGGAGCCGTGAC AGTGGCCTGGAAGGCAGATAGCAGCCCCGTCAAG GCGGGAGTGGAAACCACCACACCCTCCAAACAAA GCAACAACAAGTACGCGGCCAGCAGCTATCTGAG CCTGACGCCTGAGCAGTGGAAGTCCCACAGAAGC TACAGCTGCCAGGTCACGCATGAAGGGAGCACCG TGGAGAAGACAGTGGCCCCTACAGAATGTTCA (SEQ ID NO: 101) |

TABLE 5A-continued

Exemplary Anti-CGRP Receptor Antibody Light Chain Sequences

| Antibody ID. | LC Group | Light Chain Amino Acid Sequence | Light Chain Nucleic Acid Sequence |
|---|---|---|---|
| 01A, 01B,<br>01C, 01D,<br>01E, 01F,<br>01G | LC-04 | QSVLTQPPSVSAAPGQKVTISC<br>SGSYSNIGRYSVSWYQQLPGT<br>APKLLIYDNNKRPSGIPDRFSG<br>SKSGTSATLGITGLQTGDEAD<br>YYCGTWDSRLSAVVFGGGTK<br>LTVLGQPKAAPSVTLFPPSSEE<br>LQANKATLVCLISDFYPGAVT<br>VAWKADSSPVKAGVETTTPS<br>KQSNNKYAAKSYLSLTPEQW<br>KSHRSYSCQVTHEGSTVEKTV<br>APTECS (SEQ ID NO: 72) | CAGTCTGTGTTGACGCAGCCGCCCTCAGTGTCTGC<br>GGCCCCAGGACAGAAGGTCACCATCTCCTGCTCT<br>GGAAGCTACTCCAACATTGGGCGTTACTCTGTATC<br>CTGGTACCAGCAGCTCCCAGGAACAGCCCCCAAA<br>CTCCTCATTTATGACAATAATAAGCGACCCTCAG<br>GGATTCCTGACCGATTCTCTGGCTCCAAGTCTGGC<br>ACGTCAGCCACCCTGGGCATCACCGGACTCCAGA<br>CTGGGGACGAGGCCGATTATTACTGCGGAACATG<br>GGATAGCCGCCTGAGTGCTGTGGTTTTCGGCGGA<br>GGGACCAAGCTGACCGTCCTAGGTCAGCCCAAGG<br>CTGCACCCTCGGTCACTCTGTTCCCGCCCTCCTCT<br>GAGGAGCTTCAAGCCAACAAGGCCACACTGGTGT<br>GTCTCATCAGTGACTTCTACCCGGGAGCCGTGAC<br>AGTGGCCTGGAAGGCAGATAGCAGCCCCGTCAAG<br>GCGGGAGTGGAAACCACCACACCCTCCAAACAAA<br>GCAACAACAAGTACGCGGCCAAGAGCTATCTGAG<br>CCTGACGCCTGAGCAGTGGAAGTCCCACAGAAGC<br>TACAGCTGCCAGGTCACGCATGAAGGGAGCACCG<br>TGGAGAAGACAGTGGCCCCTACAGAATGTTCA<br>(SEQ ID NO: 102) |
| 02 | LC-05 | QSVLTQPPSVSAAPGQKVTISC<br>SGSRSNIGIKAVSWYQQLPGT<br>APKLLIYDNNKRPSGIPDRFSG<br>SKSGTSATLGITGLQTGDEAD<br>YYCGTWDSRLSAVVFGGGTK<br>LTVLGQPKAAPSVTLFPPSSEE<br>LQANKATLVCLISDFYPGAVT<br>VAWKADSSPVKAGVETTTPS<br>KQSNNKYAASSYLSLTPEQW<br>KSHRSYSCQVTHEGSTVEKTV<br>APTECS (SEQ ID NO: 73) | CAGTCTGTGTTGACGCAGCCGCCCTCAGTGTCTGC<br>GGCCCCAGGACAGAAGGTCACCATCTCCTGCTCT<br>GGAAGCCGTTCCAACATTGGGATCAAAGCTGTAT<br>CCTGGTACCAGCAGCTCCCAGGAACAGCCCCCAA<br>ACTCCTCATTTATGACAATAATAAGCGACCCTCA<br>GGGATTCCTGACCGATTCTCTGGCTCCAAGTCTGG<br>CACGTCAGCCACCCTGGGCATCACCGGACTCCAG<br>ACTGGGGACGAGGCCGATTATTACTGCGGAACAT<br>GGGATAGCCGCCTGAGTGCTGTGGTTTTCGGCGG<br>AGGGACCAAGCTGACCGTCCTAGGTCAGCCCAAG<br>GCTGCACCCTCGGTCACTCTGTTCCCGCCCTCCTC<br>TGAGGAGCTTCAAGCCAACAAGGCCACACTGGTG<br>TGTCTCATCAGTGACTTCTACCCGGGAGCCGTGAC<br>AGTGGCCTGGAAGGCAGATAGCAGCCCCGTCAAG<br>GCGGGAGTGGAAACCACCACACCCTCCAAACAAA<br>GCAACAACAAGTACGCGGCCAGCAGCTATCTGAG<br>CCTGACGCCTGAGCAGTGGAAGTCCCACAGAAGC<br>TACAGCTGCCAGGTCACGCATGAAGGGAGCACCG<br>TGGAGAAGACAGTGGCCCCTACAGAATGTTCA<br>(SEQ ID NO: 103) |
| 02A, 02B | LC-06 | QSVLTQPPSVSAAPGQKVTISC<br>SGSRSNIGIKAVSWYQQLPGT<br>APKLLIYDNNKRPSGIPDRFSG<br>SKSGTSATLGITGLQTGDEAD<br>YYCGTWDSRLSAVVFGGGTK<br>LTVLGQPKAAPSVTLFPPSSEE<br>LQANKATLVCLISDFYPGAVT<br>VAWKADSSPVKAGVETTTPS<br>KQSNNKYAAKSYLSLTPEQW<br>KSHRSYSCQVTHEGSTVEKTV<br>APTECS (SEQ ID NO: 74) | CAGTCTGTGTTGACGCAGCCGCCCTCAGTGTCTGC<br>GGCCCCAGGACAGAAGGTCACCATCTCCTGCTCT<br>GGAAGCCGTTCCAACATTGGGATCAAAGCTGTAT<br>CCTGGTACCAGCAGCTCCCAGGAACAGCCCCCAA<br>ACTCCTCATTTATGACAATAATAAGCGACCCTCA<br>GGGATTCCTGACCGATTCTCTGGCTCCAAGTCTGG<br>CACGTCAGCCACCCTGGGCATCACCGGACTCCAG<br>ACTGGGGACGAGGCCGATTATTACTGCGGAACAT<br>GGGATAGCCGCCTGAGTGCTGTGGTTTTCGGCGG<br>AGGGACCAAGCTGACCGTCCTAGGTCAGCCCAAG<br>GCTGCACCCTCGGTCACTCTGTTCCCGCCCTCCTC<br>TGAGGAGCTTCAAGCCAACAAGGCCACACTGGTG<br>TGTCTCATCAGTGACTTCTACCCGGGAGCCGTGAC<br>AGTGGCCTGGAAGGCAGATAGCAGCCCCGTCAAG<br>GCGGGAGTGGAAACCACCACACCCTCCAAACAAA<br>GCAACAACAAGTACGCGGCCAAGAGCTATCTGAG<br>CCTGACGCCTGAGCAGTGGAAGTCCCACAGAAGC<br>TACAGCTGCCAGGTCACGCATGAAGGGAGCACCG<br>TGGAGAAGACAGTGGCCCCTACAGAATGTTCA<br>(SEQ ID NO: 104) |
| 03 | LC-07 | QSVLTQPPSVSAAPGQKVTISC<br>SGSSSNIGNNYVSWYQQLPGT<br>APKLLIYDNNKRPSGIPDRFSG<br>SKSGTSTTLGITGLQTGDEAD<br>YYCGTWDSRLSAVVFGGGTK<br>LTVLGQPKAAPSVTLFPPSSEE<br>LQANKATLVCLISDFYPGAVT<br>VAWKADSSPVKAGVETTTPS<br>KQSNNKYAASSYLSLTPEQW<br>KSHRSYSCQVTHEGSTVEKTV<br>APTECS (SEQ ID NO: 75) | CAGTCTGTGTTGACGCAGCCGCCCTCAGTGTCTGC<br>GGCCCCAGGACAGAAGGTCACCATCTCCTGCTCT<br>GGAAGCAGCTCCAACATTGGGAATAATTATGTAT<br>CCTGGTACCAGCAGCTCCCAGGAACAGCCCCCAA<br>ACTCCTCATTTATGACAATAATAAGCGACCCTCA<br>GGGATTCCTGACCGATTCTCTGGCTCCAAGTCTGG<br>CACGTCAACCACCCTGGGCATCACCGGACTCCAG<br>ACTGGGGACGAGGCCGATTATTACTGCGGAACAT<br>GGGATAGCCGCCTGAGTGCTGTGGTTTTCGGCGG<br>AGGGACCAAGCTGACCGTCCTAGGTCAGCCCAAG<br>GCTGCACCCTCGGTCACTCTGTTCCCGCCCTCCTC |

TABLE 5A-continued

Exemplary Anti-CGRP Receptor Antibody Light Chain Sequences

| Antibody ID. | LC Group | Light Chain Amino Acid Sequence | Light Chain Nucleic Acid Sequence |
|---|---|---|---|
| | | | TGAGGAGCTTCAAGCCAACAAGGCCACACTGGTG TGTCTCATCAGTGACTTCTACCCGGGAGCCGTGAC AGTGGCCTGGAAGGCAGATAGCAGCCCCGTCAAG GCGGGAGTGGAAACCACCACACCCTCCAAACAAA GCAACAACAAGTACGCGGCCAGCAGCTATCTGAG CCTGACGCCTGAGCAGTGGAAGTCCCACAGAAGC TACAGCTGCCAGGTCACGCATGAAGGGAGCACCG TGGAGAAGACAGTGGCCCCTACAGAATGTTCA (SEQ ID NO: 105) |
| 03A, 03B | LC-08 | QSVLTQPPSVSAAPGQKVTISC SGSSSNIGNNYVSWYQQLPGT APKLLIYDNNKRPSGIPDRFSG SKSGTSTTLGITGLQTGDEAD YYCGTWDSRLSAVVFGGGTK LTVLGQPKAAPSVTLFPPSSEE LQANKATLVCLISDFYPGAVT VAWKADSSPVKAGVETTTPS KQSNNKYAAKSYLSLTPEQW KSHRSYSCQVTHEGSTVEKTV APTECS (SEQ ID NO: 76) | CAGTCTGTGTTGACGCAGCCGCCCTCAGTGTCTGC GGCCCCAGGACAGAAGGTCACCATCTCCTGCTCT GGAAGCAGCTCCAACATTGGGAATAATTATGTAT CCTGGTACCAGCAGCTCCCAGGAACAGCCCCCAA ACTCCTCATTTATGACAATAATAAGCGACCCTCA GGGATTCCTGACCGATTCTCTGGCTCCAAGTCTGG CACGTCAACCACCCTGGGCATCACCGGACTCCAG ACTGGGGACGAGGCCGATTATTACTGCGGAACAT GGGATAGCCGCCTGAGTGCTGTGGTTTTCGGCGG AGGGACCAAGCTGACCGTCCTAGGTCAGCCCAAG GCTGCACCCTCGGTCACTCTGTTCCCGCCCTCCTC TGAGGAGCTTCAAGCCAACAAGGCCACACTGGTG TGTCTCATCAGTGACTTCTACCCGGGAGCCGTGAC AGTGGCCTGGAAGGCAGATAGCAGCCCCGTCAAG GCGGGAGTGGAAACCACCACACCCTCCAAACAAA GCAACAACAAGTACGCGGCCAAGAGCTATCTGAG CCTGACGCCTGAGCAGTGGAAGTCCCACAGAAGC TACAGCTGCCAGGTCACGCATGAAGGGAGCACCG TGGAGAAGACAGTGGCCCCTACAGAATGTTCA (SEQ ID NO: 106) |
| 05 | LC-09 | QSVLTQPPSVSAAPGQKVTISC SGSFSNIGRSTVSWYQQLPGT APKLLIYDNRWRAGGIPDRFS GSKSGTSATLGITGLQTGDEA DYYCGTWDYQWKAVVFGGG TKLTVLGQPKAAPSVTLFPPSS EELQANKATLVCLISDFYPGA VTVAWKADSSPVKAGVETTT PSKQSNNKYAASSYLSLTPEQ WKSHRSYSCQVTHEGSTVEKT VAPTECS (SEQ ID NO: 77) | CAGTCTGTGTTGACGCAGCCGCCCTCAGTGTCTGC GGCCCCAGGACAGAAGGTCACCATCTCCTGCTCT GGAAGCTTCTCCAACATTGGGCGTTCTACTGTATC CTGGTACCAGCAGCTCCCAGGAACAGCCCCCAAA CTCCTCATTTATGACAATCGTTGGCGCGCGGGTGG GATTCCTGACCGATTCTCTGGCTCCAAGTCTGGCA CGTCAGCCACCCTGGGCATCACCGGACTCCAGAC TGGGGACGAGGCCGATTATTACTGCGGAACATGG GATTACCAGTGGAAAGCTGTGGTTTTCGGCGGAG GGACCAAGCTGACCGTCCTAGGTCAGCCCAAGGC TGCACCCTCGGTCACTCTGTTCCCGCCCTCCTCTG AGGAGCTTCAAGCCAACAAGGCCACACTGGTGTG TCTCATCAGTGACTTCTACCCGGGAGCCGTGACA GTGGCCTGGAAGGCAGATAGCAGCCCCGTCAAGG CGGGAGTGGAAACCACCACACCCTCCAAACAAAG CAACAACAAGTACGCGGCCAGCAGCTATCTGAGC CTGACGCCTGAGCAGTGGAAGTCCCACAGAAGCT ACAGCTGCCAGGTCACGCATGAAGGGAGCACCGT GGAGAAGACAGTGGCCCCTACAGAATGTTCA (SEQ ID NO: 107) |
| 06 | LC-10 | QSVLTQPPSVSAAPGQKVTISC SGSYSNIGRKSVSWYQQLPGT APKLLIYDNNKRPSGIPDRFSG SKSGTSATLGITGLQTGDEAD YYCGTWDSRLSAVVFGGGTK LTVLGQPKAAPSVTLFPPSSEE LQANKATLVCLISDFYPGAVT VAWKADSSPVKAGVETTTPS KQSNNKYAASSYLSLTPEQW KSHRSYSCQVTHEGSTVEKTV APTECS (SEQ ID NO: 78) | CAGTCTGTGTTGACGCAGCCGCCCTCAGTGTCTGC GGCCCCAGGACAGAAGGTCACCATCTCCTGCTCT GGAAGCTACTCCAACATTGGGCGTAAATCTGTAT CCTGGTACCAGCAGCTCCCAGGAACAGCCCCCAA ACTCCTCATTTATGACAATAATAAGCGACCCTCA GGGATTCCTGACCGATTCTCTGGCTCCAAGTCTGG CACGTCAGCCACCCTGGGCATCACCGGACTCCAG ACTGGGGACGAGGCCGATTATTACTGCGGAACAT GGGATAGCCGCCTGAGTGCTGTGGTTTTCGGCGG AGGGACCAAGCTGACCGTCCTAGGTCAGCCCAAG GCTGCACCCTCGGTCACTCTGTTCCCGCCCTCCTC TGAGGAGCTTCAAGCCAACAAGGCCACACTGGTG TGTCTCATCAGTGACTTCTACCCGGGAGCCGTGAC AGTGGCCTGGAAGGCAGATAGCAGCCCCGTCAAG GCGGGAGTGGAAACCACCACACCCTCCAAACAAA GCAACAACAAGTACGCGGCCAGCAGCTATCTGAG CCTGACGCCTGAGCAGTGGAAGTCCCACAGAAGC TACAGCTGCCAGGTCACGCATGAAGGGAGCACCG TGGAGAAGACAGTGGCCCCTACAGAATGTTCA (SEQ ID NO: 108) |

TABLE 5A-continued

Exemplary Anti-CGRP Receptor Antibody Light Chain Sequences

| Antibody ID. | LC Group | Light Chain Amino Acid Sequence | Light Chain Nucleic Acid Sequence |
|---|---|---|---|
| 08 | LC-11 | QSVLTQPPSVSAAPGQKVTISC SGSYSNIGWWPVSWYQQLPG TAPKLLIYDNNKRPSGIPDRFS GSKSGTSATLGITGLQTGDEA DYYCGTWDSRLSAVVFGGGT KLTVLGQPKAAPSVTLFPPSSE ELQANKATLVCLISDFYPGAV TVAWKADSSPVKAGVETTTPS KQSNNKYAASSYLSLTPEQW KSHRSYSCQVTHEGSTVEKTV APTECS (SEQ ID NO: 79) | CAGTCTGTGTTGACGCAGCCGCCCTCAGTGTCTGC GGCCCCAGGACAGAAGGTCACCATCTCCTGCTCT GGAAGCTACTCCAACATTGGGTGGTGGCCGGTAT CCTGGTACCAGCAGCTCCCAGGAACAGCCCCCAA ACTCCTCATTTATGACAATAATAAGCGACCCTCA GGGATTCCTGACCGATTCTCTGGCTCCAAGTCTGG CACGTCAGCCACCCTGGGCATCACCGGACTCCAG ACTGGGGACGAGGCCGATTATTACTGCGGAACAT GGGATAGCCGCCTGAGTGCTGTGGTTTTCGGCGG AGGGACCAAGCTGACCGTCCTAGGTCAGCCCAAG GCTGCACCCTCGGTCACTCTGTTCCCGCCCTCCTC TGAGGAGCTTCAAGCCAACAAGGCCACACTGGTG TGTCTCATCAGTGACTTCTACCCGGGAGCCGTGAC AGTGGCCTGGAAGGCAGATAGCAGCCCCGTCAAG GCGGGAGTGGAAACCACCACACCCTCCAAACAAA GCAACAACAAGTACGCGGCCAGCAGCTATCTGAG CCTGACGCCTGAGCAGTGGAAGTCCCACAGAAGC TACAGCTGCCAGGTCACGCATGAAGGGAGCACCG TGGAGAAGACAGTGGCCCCTACAGAATGTTCA (SEQ ID NO: 109) |
| 11 | LC-12 | QSVLTQPPSVSAAPGQKVTISC SGSRSNIGRYSVSWYQQLPGT APKLLIYENMFRPRGIPDRFSG SKSGTSATLGITGLQTGDEAD YYCGTWDYRMQAVVFGGGT KLTVLGQPKAAPSVTLFPPSSE ELQANKATLVCLISDFYPGAV TVAWKADSSPVKAGVETTTPS KQSNNKYAASSYLSLTPEQW KSHRSYSCQVTHEGSTVEKTV APTECS (SEQ ID NO: 80) | CAGTCTGTGTTGACGCAGCCGCCCTCAGTGTCTGC GGCCCCAGGACAGAAGGTCACCATCTCCTGCTCT GGAAGCCGTTCCAACATTGGGCGTTACTCTGTATC CTGGTACCAGCAGCTCCCAGGAACAGCCCCCAAA CTCCTCATTTATGAAAATATGTTCCGCCCGCGTGG GATTCCTGACCGATTCTCTGGCTCCAAGTCTGGCA CGTCAGCCACCCTGGGCATCACCGGACTCCAGAC TGGGGACGAGGCCGATTATTACTGCGGAACATGG GATTACCGTATGCAGGCTGTGGTTTTCGGCGGAG GGACCAAGCTGACCGTCCTAGGTCAGCCCAAGGC TGCACCCTCGGTCACTCTGTTCCCGCCCTCCTCTG AGGAGCTTCAAGCCAACAAGGCCACACTGGTGTG TCTCATCAGTGACTTCTACCCGGGAGCCGTGACA GTGGCCTGGAAGGCAGATAGCAGCCCCGTCAAGG CGGGAGTGGAAACCACCACACCCTCCAAACAAAG CAACAACAAGTACGCGGCCAGCAGCTATCTGAGC CTGACGCCTGAGCAGTGGAAGTCCCACAGAAGCT ACAGCTGCCAGGTCACGCATGAAGGGAGCACCGT GGAGAAGACAGTGGCCCCTACAGAATGTTCA (SEQ ID NO: 110) |
| 12 | LC-13 | QSVLTQPPSVSAAPGQKVTISC SGSRSNIGRYSVSWYQQLPGT APKLLIYDNRYRAQGIPDRFSG SKSGTSATLGITGLQTGDEAD YYCGTWDWATTSVVFGGGTK LTVLGQPKAAPSVTLFPPSSEE LQANKATLVCLISDFYPGAVT VAWKADSSPVKAGVETTTPS KQSNNKYAASSYLSLTPEQW KSHRSYSCQVTHEGSTVEKTV APTECS (SEQ ID NO: 81) | CAGTCTGTGTTGACGCAGCCGCCCTCAGTGTCTGC GGCCCCAGGACAGAAGGTCACCATCTCCTGCTCT GGAAGCCGTTCCAACATTGGGCGTTACTCTGTATC CTGGTACCAGCAGCTCCCAGGAACAGCCCCCAAA CTCCTCATTTATGACAATCGTTACCGCGCGCAGGG GATTCCTGACCGATTCTCTGGCTCCAAGTCTGGCA CGTCAGCCACCCTGGGCATCACCGGACTCCAGAC TGGGGACGAGGCCGATTATTACTGCGGAACATGG GATTGGGCTACTACTTCTGTGGTTTTCGGCGGAGG GACCAAGCTGACCGTCCTAGGTCAGCCCAAGGCT GCACCCTCGGTCACTCTGTTCCCGCCCTCCTCTGA GGAGCTTCAAGCCAACAAGGCCACACTGGTGTGT CTCATCAGTGACTTCTACCCGGGAGCCGTGACAG TGGCCTGGAAGGCAGATAGCAGCCCCGTCAAGGC GGGAGTGGAAACCACCACACCCTCCAAACAAAGC AACAACAAGTACGCGGCCAGCAGCTATCTGAGCC TGACGCCTGAGCAGTGGAAGTCCCACAGAAGCTA CAGCTGCCAGGTCACGCATGAAGGGAGCACCGTG GAGAAGACAGTGGCCCCTACAGAATGTTCA (SEQ ID NO: 111) |
| 13 | LC-14 | QSVLTQPPSVSAAPGQKVTISC SGSRSNIGRRTVSWYQQLPGT APKLLIYDNNKRPSGIPDRFSG SKSGTSATLGITGLQTGDEAD YYCGTWDSRLSAVVFGGGTK LTVLGQPKAAPSVTLFPPSSEE LQANKATLVCLISDFYPGAVT VAWKADSSPVKAGVETTTPS KQSNNKYAASSYLSLTPEQW KSHRSYSCQVTHEGSTVEKTV APTECS (SEQ ID NO: 82) | CAGTCTGTGTTGACGCAGCCGCCCTCAGTGTCTGC GGCCCCAGGACAGAAGGTCACCATCTCCTGCTCT GGAAGCCGTTCCAACATTGGGCGTCGTACTGTAT CCTGGTACCAGCAGCTCCCAGGAACAGCCCCCAA ACTCCTCATTTATGACAATAATAAGCGACCCTCA GGGATTCCTGACCGATTCTCTGGCTCCAAGTCTGG CACGTCAGCCACCCTGGGCATCACCGGACTCCAG ACTGGGGACGAGGCCGATTATTACTGCGGAACAT GGGATAGCCGCCTGAGTGCTGTGGTTTTCGGCGG AGGGACCAAGCTGACCGTCCTAGGTCAGCCCAAG GCTGCACCCTCGGTCACTCTGTTCCCGCCCTCCTC |

TABLE 5A-continued

| Exemplary Anti-CGRP Receptor Antibody Light Chain Sequences | | | |
|---|---|---|---|
| Antibody ID. | LC Group | Light Chain Amino Acid Sequence | Light Chain Nucleic Acid Sequence |
| | | | TGAGGAGCTTCAAGCCAACAAGGCCACACTGGTG<br>TGTCTCATCAGTGACTTCTACCCGGGAGCCGTGAC<br>AGTGGCCTGGAAGGCAGATAGCAGCCCCGTCAAG<br>GCGGGAGTGGAAACCACCACACCCTCCAAACAAA<br>GCAACAACAAGTACGCGGCCAGCAGCTATCTGAG<br>CCTGACGCCTGAGCAGTGGAAGTCCCACAGAAGC<br>TACAGCTGCCAGGTCACGCATGAAGGGAGCACCG<br>TGGAGAAGACAGTGGCCCCTACAGAATGTTCA<br>(SEQ ID NO: 112) |
| 14 | LC-15 | QSVLTQPPSVSAAPGQKVTISC<br>SGSSSNIGNNYVSWYQQLPGT<br>APKLLIYDNNKRPSGIPDRFSG<br>SKSGTSATLGITGLQTGDEAD<br>YYCGTWDSWHRVVTFGGGT<br>KLTVLGQPKAAPSVTLFPPSSE<br>ELQANKATLVCLISDFYPGAV<br>TVAWKADSSPVKAGVETTTPS<br>KQSNNKYAASSYLSLTPEQW<br>KSHRSYSCQVTHEGSTVEKTV<br>APTECS (SEQ ID NO: 83) | CAGTCTGTGTTGACGCAGCCGCCCTCAGTGTCTGC<br>GGCCCCAGGACAGAAGGTCACCATCTCCTGCTCT<br>GGAAGCAGCTCCAACATTGGGAATAATTATGTAT<br>CCTGGTACCAGCAGCTCCCAGGAACAGCCCCCAA<br>ACTCCTCATTTATGACAATAATAAGCGACCCTCA<br>GGGATTCCTGACCGATTCTCTGGCTCCAAGTCTGG<br>CACGTCAGCCACCCTGGGCATCACCGGACTCCAG<br>ACTGGGGACGAGGCCGATTATTACTGCGGAACAT<br>GGGATTCTTGGCATCGTGTTGTGACTTTCGGCGGA<br>GGGACCAAGCTGACCGTCCTAGGTCAGCCCAAGG<br>CTGCACCCTCGGTCACTCTGTTCCCGCCCTCCTCT<br>GAGGAGCTTCAAGCCAACAAGGCCACACTGGTGT<br>GTCTCATCAGTGACTTCTACCCGGGAGCCGTGAC<br>AGTGGCCTGGAAGGCAGATAGCAGCCCCGTCAAG<br>GCGGGAGTGGAAACCACCACACCCTCCAAACAAA<br>GCAACAACAAGTACGCGGCCAGCAGCTATCTGAG<br>CCTGACGCCTGAGCAGTGGAAGTCCCACAGAAGC<br>TACAGCTGCCAGGTCACGCATGAAGGGAGCACCG<br>TGGAGAAGACAGTGGCCCCTACAGAATGTTCA<br>(SEQ ID NO: 113) |
| 15 | LC-16 | QSVLTQPPSVSAAPGQKVTISC<br>SGSSSNIGNNYVSWYQQLPGT<br>APKLLIYDNNKRPSGIPDRFSG<br>SKSGTSATLGITGLQTGDEAD<br>YYCGTWDWWRKAVIFGGGT<br>KLTVLGQPKAAPSVTLFPPSSE<br>ELQANKATLVCLISDFYPGAV<br>TVAWKADSSPVKAGVETTTPS<br>KQSNNKYAASSYLSLTPEQW<br>KSHRSYSCQVTHEGSTVEKTV<br>APTECS (SEQ ID NO: 84) | CAGTCTGTGTTGACGCAGCCGCCCTCAGTGTCTGC<br>GGCCCCAGGACAGAAGGTCACCATCTCCTGCTCT<br>GGAAGCAGCTCCAACATTGGGAATAATTATGTAT<br>CCTGGTACCAGCAGCTCCCAGGAACAGCCCCCAA<br>ACTCCTCATTTATGACAATAATAAGCGACCCTCA<br>GGGATTCCTGACCGATTCTCTGGCTCCAAGTCTGG<br>CACGTCAGCCACCCTGGGCATCACCGGACTCCAG<br>ACTGGGGACGAGGCCGATTATTACTGCGGAACAT<br>GGGATTGGTGGCGTAAAGCTGTGATTTTCGGCGG<br>AGGGACCAAGCTGACCGTCCTAGGTCAGCCCAAG<br>GCTGCACCCTCGGTCACTCTGTTCCCGCCCTCCTC<br>TGAGGAGCTTCAAGCCAACAAGGCCACACTGGTG<br>TGTCTCATCAGTGACTTCTACCCGGGAGCCGTGAC<br>AGTGGCCTGGAAGGCAGATAGCAGCCCCGTCAAG<br>GCGGGAGTGGAAACCACCACACCCTCCAAACAAA<br>GCAACAACAAGTACGCGGCCAGCAGCTATCTGAG<br>CCTGACGCCTGAGCAGTGGAAGTCCCACAGAAGC<br>TACAGCTGCCAGGTCACGCATGAAGGGAGCACCG<br>TGGAGAAGACAGTGGCCCCTACAGAATGTTCA<br>(SEQ ID NO: 114) |

TABLE 5B

| Exemplary Anti-CGRP Receptor Antibody Heavy Chain Sequences | | | |
|---|---|---|---|
| Antibody ID. | HC Group | Heavy Chain Amino Acid Sequence | Heavy Chain Nucleic Acid Sequence |
| 4E4 | HC-01 | QVQLVESGGGVVQPGRSLRLSC<br>AASGFTFSSFGMHWVRQAPGKG<br>LEWVAVISFDGSIKYSVDSVKGR<br>FTISRDNSKNTLFLQMNSLRAED<br>TAVYYCARDRLNYYDSSGYYH<br>YKYYGMAVWGQGTTVTVSSAS<br>TKGPSVFPLAPCSRSTSESTAAL<br>GCLVKDYFPEPVTVSWNSGALT<br>SGVHTFPAVLQSSGLYSLSSVVT<br>VPSSNFGTQTYTCNVDHKPSNT<br>KVDKTVERKCCVECPPCPAPPV<br>AGPSVFLFPPKPKDTLMISRTPEV<br>TCVVVDVSHEDPEVQFNWYVD | CAGGTGCAGCTGGTGGAATCTGGGGGAGGCGTGG<br>TCCAGCCTGGGAGGTCCCTGAGACTCTCCTGTGC<br>AGCCTCTGGATTCACCTTCAGTAGCTTTGGCATGC<br>ACTGGGTCCGCCAGGCTCCAGGCAAGGGGCTGGA<br>GTGGGTGGCAGTTATATCATTTGATGGAAGTATT<br>AAGTATTCTGTAGACTCCGTGAAGGGCCGATTC<br>ACCATCTCCAGAGACAATTCAAAGAACACGCTGT<br>TTCTGCAAATGAACAGCCTGCGAGCCGAGGACAC<br>GGCTGTGTATTACTGTGCGAGAGATCGGCTCAAT<br>TACTATGATAGTAGTGGTTATTATCACTACAAATA<br>CTACGGTATGGCCGTCTGGGGCCAAGGGACCAC<br>GGTCACCGTCTCTAGTGCCTCCACCAAGGGCCCA<br>TCGGTCTTCCCCCTGGCGCCCTGCTCCAGGAGCAC |

TABLE 5B-continued

Exemplary Anti-CGRP Receptor Antibody Heavy Chain Sequences

| Antibody ID. | HC Group | Heavy Chain Amino Acid Sequence | Heavy Chain Nucleic Acid Sequence |
|---|---|---|---|
| | | GVEVHNAKTKPREEQFNSTFRV<br>VSVLTVVHQDWLNGKEYKCKV<br>SNKGLPAPIEKTISKTKGQPREPQ<br>VYTLPPSREEMTKNQVSLTCLV<br>KGFYPSDIAVEWESNGQPENNY<br>KTTPPMLD SDGSFFLYSKLTVDK<br>SRWQQGNVFSCSVMHEALHNH<br>YTQKSLSLSPGK<br>(SEQ ID NO: 85) | CTCCGAGAGCACAGCGGCCCTGGGCTGCCTGGTC<br>AAGGACTACTTCCCCGAACCGGTGACGGTGTCGT<br>GGAACTCAGGCGCTCTGACCAGCGGCGTGCACA<br>CCTTCCCAGCTGTCCTACAGTCCTCAGGACTCTAC<br>TCCCTCAGCAGCGTGGTGACCGTGCCCTCCAGCA<br>ACTTCGGCACCCAGACCTACACCTGCAACGTAGA<br>TCACAAGCCCAGCAACACCAAGGTGGACAAGAC<br>AGTTGAGCGCAAATGTTGTGTCGAGTGCCCACCG<br>TGCCCAGCACCACCTGTGGCAGGACCGTCAGTCT<br>TCCTCTTCCCCCCAAAACCCAAGGACACCCTCATG<br>ATCTCCCGGACCCCTGAGGTCACGTGCGTGGTGG<br>TGGACGTGAGCCACGAAGACCCCGAGGTCCAGTT<br>CAACTGGTACGTGGACGGCGTGGAGGTGCATAA<br>TGCCAAGACAAAGCCACGGGAGGAGCAGTTCAA<br>CAGCACGTTCCGTGTGGTCAGCGTCCTCACCGTTG<br>TGCACCAGGACTGGCTGAACGGCAAGGAGTACAA<br>GTGCAAGGTCTCCAACAAAGGCCTCCCAGCCCCC<br>ATCGAGAAAACCATCTCCAAAACCAAAGGGCAGC<br>CCCGAGAACCACAGGTGTACACCCTGCCCCCATC<br>CCGGGAGGAGATGACCAAGAACCAGGTCAGCCT<br>GACCTGCCTGGTCAAAGGCTTCTACCCCAGCGAC<br>ATCGCCGTGGAGTGGGAGAGCAATGGGCAGCCG<br>GAGAACAACTACAAGACCACACCTCCCATGCTGG<br>ACTCCGACGGCTCCTTCTTCCTCTACAGCAAGCTC<br>ACCGTGGACAAGAGCAGGTGGCAGCAGGGGAAC<br>GTCTTCTCATGCTCCGTGATGCATGAGGCTCTGCA<br>CAACCACTACACGCAGAAGAGCCTCTCCCTGTCT<br>CCGGGTAAA (SEQ ID NO: 115) |
| 4E4.2, 01,<br>02, 05, 06,<br>08, 12, 13,<br>14, 15 | HC-02 | QVQLVESGGGVVQPGRSLRLSC<br>AASGFTFSSFGMHWVRQAPGKG<br>LEWVAVISFDGSIKYSVDSVKGR<br>FTISRDNSKNTLFLQMNSLRAED<br>TAVYYCARDRLNYYESSGYYH<br>YKYYGMAVWGQGTTVTVSSAS<br>TKGPSVFPLAPSSKSTSGGTAAL<br>GCLVKDYFPEPVTVSWNSGALT<br>SGVHTFPAVLQSSGLYSLSSVVT<br>VPSSSLGTQTYICNVNHKPSNTK<br>VDKKVEPKSCDKTHTCPPCPAPE<br>LLGGPSVFLFPPKPKDTLMISRTP<br>EVTCVVVDVSHEDPEVKFNWY<br>VDGVEVHNAKTKPCEEQYGSTY<br>RCVSVLTVLHQDWLNGKEYKC<br>KVSNKALPAPIEKTISKAKGQPR<br>EPQVYTLPPSREEMTKNQVSLTC<br>LVKGFYPSDIAVEWESNGQPEN<br>NYKTTPPVLDSDGSFFLYSKLTV<br>DKSRWQQGNVFSCSVMHEALH<br>NHYTQKSLSLSPGK (SEQ ID NO:<br>86) | CAGGTGCAGCTGGTGGAATCTGGGGGAGGCGTGG<br>TCCAGCCTGGGAGGTCCCTGAGACTCTCCTGTGC<br>AGCCTCTGGATTCACCTTCAGTAGCTTTGGCATGC<br>ACTGGGTCCGCCAGGCTCCAGGCAAGGGGCTGGA<br>GTGGGTGGCAGTTATATCATTTGATGGAAGTATT<br>AAGTATTCTGTAGACTCCGTGAAGGGCCGATTCA<br>CCATCTCCAGAGACAATTCAAAGAACACGCTGTT<br>TCTGCAAATGAACAGCCTGCGAGCCGAGGACACG<br>GCTGTGTATTACTGTGCGAGAGATCGGCTCAATT<br>ACTATGAGAGTAGTGGTTATTATCACTACAAATA<br>CTACGGTATGGCCGTCTGGGGCCAAGGGACAACA<br>GTTACCGTGTCTAGTGCCTCCACCAAGGGCCCATC<br>GGTCTTCCCCCTGGCACCCTCCTCCAAGAGCACCT<br>CTGGGGGCACAGCGGCCCTGGGCTGCCTGGTCAA<br>GGACTACTTCCCCGAACCGGTGACGGTGTCGTGG<br>AACTCAGGCGCCCTGACCAGCGGCGTGCACACCT<br>TCCCGGCTGTCCTACAGTCCTCAGGACTCTACTCC<br>CTCAGCAGCGTGGTGACCGTGCCCTCCAGCAGCT<br>TGGGCACCCAGACCTACATCTGCAACGTGAATCA<br>CAAGCCCAGCAACACCAAGGTGGACAAGAAAGT<br>TGAGCCCAAATCTTGTGACAAAACTCACACATGC<br>CCACCGTGCCCAGCACCTGAACTCCTGGGGGGAC<br>CGTCAGTCTTCCTCTTCCCCCCAAAACCCAAGGAC<br>ACCCTCATGATCTCCCGGACCCCTGAGGTCACAT<br>GCGTGGTGGTGGACGTGAGCCACGAAGACCCTGA<br>GGTCAAGTTCAACTGGTACGTGGACGGCGTGGAG<br>GTGCATAATGCCAAGACAAAGCCGTGCGAGGAGC<br>AGTACGGCAGCACGTACCGTTGCGTCAGCGTCCT<br>CACCGTCCTGCACCAGGACTGGCTGAATGGCAAG<br>GAGTACAAGTGCAAGGTGTCCAACAAAGCCCTCC<br>CAGCCCCCATCGAGAAAACCATCTCCAAAGCCAA<br>AGGGCAGCCCCGAGAACCACAGGTGTACACCCTG<br>CCCCCATCCCGGGAGGAGATGACCAAGAACCAGG<br>TCAGCCTGACCTGCCTGGTCAAAGGCTTCTATCCC<br>AGCGACATCGCCGTGGAGTGGGAGAGCAATGGG<br>CAGCCGGAGAACAACTACAAGACCACGCCTCCCG<br>TGCTGGACTCCGACGGCTCCTTCTTCCTCTATAGC<br>AAGCTCACCGTGGACAAGAGCAGGTGGCAGCAG<br>GGGAACGTCTTCTCATGCTCCGTGATGCATGAGG<br>CTCTGCACAACCACTACACGCAGAAGAGCCTCTC<br>CCTGTCTCCGGGTAAA (SEQ ID NO: 116) |
| 01A, 01C<br>02A | HC-03 | QVQLVESGGGVVQPGRSLRLSC<br>AASGFTFSSFGMHWVRQAPGKG<br>LEWVAVISFDGSIKYSVDSVKGR<br>FTISRDNSKNTLFLQMNSLRAED | CAGGTGCAGCTGGTGGAATCTGGGGGAGGCGTGG<br>TCCAGCCTGGGAGGTCCCTGAGACTCTCCTGTGC<br>AGCCTCTGGATTCACCTTCAGTAGCTTTGGCATGC<br>ACTGGGTCCGCCAGGCTCCAGGCAAGGGGCTGGA |

TABLE 5B-continued

Exemplary Anti-CGRP Receptor Antibody Heavy Chain Sequences

| Antibody ID. | HC Group | Heavy Chain Amino Acid Sequence | Heavy Chain Nucleic Acid Sequence |
|---|---|---|---|
| | | TAVYYCARDRLNYYESSGYYH<br>YKYYGMAVWGQGTTVTVSSAS<br>TKGPSVFPLAPSSKSTSGGTAAL<br>GCLVKDYFPEPVTVSWNSGALT<br>SGVHTFPAVLQSSGLYSLESVVT<br>VPSSSLGTQTYICNVNHKPSNTK<br>VDKKVEPKSCDKTHTCPPCPAPE<br>LLGGPSVFLFPPKPKDTLMISRTP<br>EVTCVVVDVSHEDPEVKFNWY<br>VDGVEVHNAKTKPCEEQYGSTY<br>RCVSVLTVLHQDWLNGKEYKC<br>KVSNKALPAPIEKTISKAKGQPR<br>EPQVYTLPPSRKEMTKNQVSLT<br>CLVKGFYPSDIAVEWESNGQPE<br>NNYKTTPPVLKSDGSFFLYSKLT<br>VDKSRWQQGNVFSCSVMHEAL<br>HNHYTQKSLSLSPGK (SEQ ID<br>NO: 87) | GTGGGTGGCAGTTATCTCATTTGATGGAAGTATTA<br>AGTATTCTGTAGACTCCGTGAAGGGCCGATTCAC<br>CATCTCCAGAGACAATTCAAAGAACACGCTGTTT<br>CTGCAAATGAACAGCCTGCGAGCCGAGGACACGG<br>CTGTGTATTACTGTGCGAGAGATCGGCTCAATTAC<br>TATGAGAGTAGTGGTTATTATCACTACAAATACT<br>ACGGTATGGCCGTCTGGGGCCAAGGGACAACAGT<br>TACCGTGTCTAGTGCCTCCACCAAGGGCCCATCG<br>GTCTTCCCCCTGGCACCCTCCTCCAAGAGCACCTC<br>TGGGGGCACAGCGGCCCTGGGCTGCCTGGTCAAG<br>GACTACTTCCCCGAACCGGTGACGGTGTCGTGGA<br>ACTCAGGCGCCCTGACCAGCGGCGTGCACACCTT<br>CCCGGCTGTCCTACAGTCCTCAGGACTCTACTCCC<br>TCGAGAGCGTGGTGACCGTGCCCTCCAGCAGCTT<br>GGGCACCCAGACCTACATCTGCAACGTGAATCAC<br>AAGCCCAGCAACACCAAGGTGGACAAGAAAGTT<br>GAGCCCAAATCTTGTGACAAAACTCACACATGCC<br>CACCGTGCCCAGCACCTGAACTCCTGGGGGGACC<br>GTCAGTCTTCCTCTTCCCCCCAAAACCCAAGGACA<br>CCCTCATGATCTCCCGGACCCCTGAGGTCACATGC<br>GTGGTGGTGGACGTGAGCCACGAAGACCCTGAGG<br>TCAAGTTCAACTGGTACGTGGACGGCGTGGAGGT<br>GCATAATGCCAAGACAAAGCCGTGCGAGGAGCA<br>GTACGGCAGCACGTACCGTTGCGTCAGCGTCCTC<br>ACCGTCCTGCACCAGGACTGGCTGAATGGCAAGG<br>AGTACAAGTGCAAGGTGTCCAACAAAGCCCTCCC<br>AGCCCCCATCGAGAAAACCATCTCCAAAGCCAAA<br>GGGCAGCCCCGAGAACCACAGGTGTACACCCTGC<br>CCCCATCCCGGAAGGAGATGACCAAGAACCAGGT<br>CAGCCTGACCTGCCTGGTCAAAGGCTTCTATCCCA<br>GCGACATCGCCGTGGAGTGGGAGAGCAATGGGC<br>AGCCGGAGAACAACTACAAGACCACGCCTCCCGT<br>GCTGAAGTCCGACGGCTCCTTCTTCCTCTATAGCA<br>AGCTCACCGTGGACAAGAGCAGGTGGCAGCAGG<br>GGAACGTCTTCTCATGCTCCGTGATGCATGAGGCT<br>CTGCACAACCACTACACGCAGAAGAGCCTCTCCC<br>TGTCTCCGGGTAAA (SEQ ID NO: 117) |
| 01B, 02B | HC-04 | QVQLVESGGGVVQPGRSLRLSC<br>AASGFTFSSFGMHWVRQAPGKG<br>LEWVAVISFDGSIKYSVDSVKGR<br>FTISRDNSKNTLFLQMNSLRAED<br>TAVYYCARDRLNYYESSGYYH<br>YKYYGMAVWGQGTTVTVSSAS<br>TKGPSVFPLAPSSKSTSGGTAAL<br>GCLVKDYFPEPVTVSWNSGALT<br>SGVHTFPAVLQSSGLYSLESVVT<br>VPSSSLGTQTYICNVNHKPSNTK<br>VDKKVEPKSCDKTHTCPPCPAPE<br>LLGGPSVFLFPPKPKDTLMISRTP<br>EVTCVVVDVSHEDPEVKFNWY<br>VDGVEVHNAKTKPCEEQYGSTY<br>RCVSVLTVLHQDWLNGKEYKC<br>KVSNKALPAPIEKTISKAKGQPR<br>EPQVYTLPPSRKKMTKNQVSLT<br>CLVKGFYPSDIAVEWESNGQPE<br>NNYKTTPPVLKSDGSFFLYSKLT<br>VDKSRWQQGNVFSCSVMHEAL<br>HNHYTQKSLSLSPGK (SEQ ID<br>NO: 88) | CAGGTGCAGCTGGTGGAATCTGGGGGAGGCGTGG<br>TCCAGCCTGGGAGGTCCCTGAGACTCTCCTGTGC<br>AGCCTCTGGATTCACCTTCAGTAGCTTTGGCATGC<br>ACTGGGTCCGCCAGGCTCCAGGCAAGGGGCTGGA<br>GTGGGTGGCAGTTATCTCATTTGATGGAAGTATTA<br>AGTATTCTGTAGACTCCGTGAAGGGCCGATTCAC<br>CATCTCCAGAGACAATTCAAAGAACACGCTGTTT<br>CTGCAAATGAACAGCCTGCGAGCCGAGGACACGG<br>CTGTGTATTACTGTGCGAGAGATCGGCTCAATTAC<br>TATGAGAGTAGTGGTTATTATCACTACAAATACT<br>ACGGTATGGCCGTCTGGGGCCAAGGGACAACAGT<br>TACCGTGTCTAGTGCCTCCACCAAGGGCCCATCG<br>GTCTTCCCCCTGGCACCCTCCTCCAAGAGCACCTC<br>TGGGGGCACAGCGGCCCTGGGCTGCCTGGTCAAG<br>GACTACTTCCCCGAACCGGTGACGGTGTCGTGGA<br>ACTCAGGCGCCCTGACCAGCGGCGTGCACACCTT<br>CCCGGCTGTCCTACAGTCCTCAGGACTCTACTCCC<br>TCGAGAGCGTGGTGACCGTGCCCTCCAGCAGCTT<br>GGGCACCCAGACCTACATCTGCAACGTGAATCAC<br>AAGCCCAGCAACACCAAGGTGGACAAGAAAGTT<br>GAGCCCAAATCTTGTGACAAAACTCACACATGCC<br>CACCGTGCCCAGCACCTGAACTCCTGGGGGGACC<br>GTCAGTCTTCCTCTTCCCCCCAAAACCCAAGGACA<br>CCCTCATGATCTCCCGGACCCCTGAGGTCACATGC<br>GTGGTGGTGGACGTGAGCCACGAAGACCCTGAGG<br>TCAAGTTCAACTGGTACGTGGACGGCGTGGAGGT<br>GCATAATGCCAAGACAAAGCCGTGCGAGGAGCA<br>GTACGGCAGCACGTACCGTTGCGTCAGCGTCCTC<br>ACCGTCCTGCACCAGGACTGGCTGAATGGCAAGG<br>AGTACAAGTGCAAGGTGTCCAACAAAGCCCTCCC<br>AGCCCCCATCGAGAAAACCATCTCCAAAGCCAAA<br>GGGCAGCCCCGAGAACCACAGGTGTACACCCTGC<br>CCCCATCCCGGAAGAAGATGACCAAGAACCAGGT<br>CAGCCTGACCTGCCTGGTCAAAGGCTTCTATCCCA<br>GCGACATCGCCGTGGAGTGGGAGAGCAATGGGC<br>AGCCGGAGAACAACTACAAGACCACGCCTCCCGT<br>GCTGAAGTCCGACGGCTCCTTCTTCCTCTATAGCA |

TABLE 5B-continued

Exemplary Anti-CGRP Receptor Antibody Heavy Chain Sequences

| Antibody ID. | HC Group | Heavy Chain Amino Acid Sequence | Heavy Chain Nucleic Acid Sequence |
|---|---|---|---|
| | | | AGCTCACCGTGGACAAGAGCAGGTGGCAGCAGG GGAACGTCTTCTCATGCTCCGTGATGCATGAGGCT CTGCACAACCACTACACGCAGAAGAGCCTCTCCC TGTCTCCGGGTAAA (SEQ ID NO: 118) |
| 01D | HC-05 | QVQLVESGGGVVQPGRSLRLSC AASGFTFSSFGMHWVRQAPGKG LEWVAVISFDGSIKYSVDSVKGR FTISRDNSKNTLFLQMNSLRAED TAVYYCARDRLNYYESSGYYH YKYYGMAVWGQGTTVTVSSAS TKGPSVFPLAPSSKSTSGGTAAL GCLVKDYFPEPVTVSWNSGALT SGVHTFPAVLQSSGLYSLESVVT VPSSSLGTQTYICNVNHKPSNTK VDKKVEPKSCDKTHTCPPCPAPE LLGGPSVFLFPPKPKDTLMISRTP EVTCVVVDVSHEDPEVKFNWY VDGVEVHNAKTKPCEEQYGSTY RCVSVLTVLHQDWLNGKEYKC KVSNKALPAPIEKTISKAKGQPR EPQVYTLPPSREKMTKNQVSLT CLVKGFYPSDIAVEWESNGQPE NNYKTTPPVLKSDGSFFLYSKLT VDKSRWQQGNVFSCSVMHEAL HNHYTQKSLSLSPGK (SEQ ID NO: 89) | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATCTCATTTGATGGAAGTATTA AGTATTCTGTAGACTCCGTGAAGGGCCGATTCAC CATCTCCAGAGACAATTCAAAGAACACGCTGTTT CTGCAAATGAACAGCCTGCGAGCCGAGGACACGG CTGTGTATTACTGTGCGAGAGATCGGCTCAATTAC TATGAGAGTAGTGGTTATTATCACTACAAATACT ACGGTATGGCCGTCTGGGGCCAAGGGACAACAGT TACCGTGTCTAGTGCCTCCACCAAGGGCCCATCG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCGAGAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TCAAGTTCAACTGGTACGTGGACGGCGTGGAGGT GCATAATGCCAAGACAAAGCCGTGCGAGGAGCA GTACGGCAGCACGTACCGTTGCGTCAGCGTCCTC ACCGTCCTGCACCAGGACTGGCTGAATGGCAAGG AGTACAAGTGCAAGGTGTCCAACAAAGCCCTCCC AGCCCCCATCGAGAAAACCATCTCCAAAGCCAAA GGGCAGCCCCGAGAACCACAGGTGTACACCCTGC CCCCATCCCGGGAGAAGATGACCAAGAACCAGGT CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT GCTGAAGTCCGACGGCTCCTTCTTCCTCTATAGCA AGCTCACCGTGGACAAGAGCAGGTGGCAGCAGG GGAACGTCTTCTCATGCTCCGTGATGCATGAGGCT CTGCACAACCACTACACGCAGAAGAGCCTCTCCC TGTCTCCGGGCAAA (SEQ ID NO: 119) |
| 01E, 01F | HC-06 | QVQLVESGGGVVQPGRSLRLSC AASGFTFSSFGMHWVRQAPGKG LEWVAVISFDGSIKYSVDSVKGR FTISRDNSKNTLFLQMNSLRAED TAVYYCARDRLNYYESSGYYH YKYYGMAVWGQGTTVTVSSAS TKGPSVFPLAPSSKSTSGGTAAL GCLVKDYFPEPVTVSWNSGALT SGVHTFPAVLQSSGLYSLESVVT VPSSSLGTQTYICNVNHKPSNTK VDKKVEPKSCDKTHTCPPCPAPE LLGGPSVFLFPPKPKDTLYITREP EVTCVVVDVSHEDPEVKFNWY VDGVEVHNAKTKPCEEQYGSTY RCVSVLTVLHQDWLNGKEYKC KVSNKALPAPIEKTISKAKGQPR EPQVYTLPPSRKEMTKNQVSLT CLVKGFYPSDIAVEWESNGQPE NNYKTTPPVLKSDGSFFLYSKLT VDKSRWQQGNVFSCSVMHEAL HNHYTQKSLSLSPGK (SEQ ID NO: 90) | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATCTCATTTGATGGAAGTATTA AGTATTCTGTAGACTCCGTGAAGGGCCGATTCAC CATCTCCAGAGACAATTCAAAGAACACGCTGTTT CTGCAAATGAACAGCCTGCGAGCCGAGGACACGG CTGTGTATTACTGTGCGAGAGATCGGCTCAATTAC TATGAGAGTAGTGGTTATTATCACTACAAATACT ACGGTATGGCCGTCTGGGGCCAAGGGACAACAGT TACCGTGTCTAGTGCCTCCACCAAGGGCCCATCG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCGAGAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCTATATCACCCGGGAGCCTGAGGTCACATG CGTGGTGGTGGACGTGAGCCACGAAGACCCTGAG GTCAAGTTCAACTGGTACGTGGACGGCGTGGAGG TGCATAATGCCAAGACAAAGCCGTGCGAGGAGCA GTACGGCAGCACGTACCGTTGCGTCAGCGTCCTC |

TABLE 5B-continued

| Exemplary Anti-CGRP Receptor Antibody Heavy Chain Sequences | | | |
|---|---|---|---|
| Antibody ID. | HC Group | Heavy Chain Amino Acid Sequence | Heavy Chain Nucleic Acid Sequence |
| | | | ACCGTCCTGCACCAGGACTGGCTGAATGGCAAGG<br>AGTACAAGTGCAAGGTGTCCAACAAAGCCCTCCC<br>AGCCCCCATCGAGAAAACCATCTCCAAAGCCAAA<br>GGGCAGCCCCGAGAACCACAGGTGTACACCCTGC<br>CCCCATCCCGGAAGGAGATGACCAAGAACCAGGT<br>CAGCCTGACCTGCCTGGTCAAAGGCTTCTATCCCA<br>GCGACATCGCCGTGGAGTGGGAGAGCAATGGGC<br>AGCCGGAGAACAACTACAAGACCACGCCTCCCGT<br>GCTGAAGTCCGACGGCTCCTTCTTCCTCTATAGCA<br>AGCTCACCGTGGACAAGAGCAGGTGGCAGCAGG<br>GGAACGTCTTCTCATGCTCCGTGATGCATGAGGCT<br>CTGCACAACCACTACACGCAGAAGAGCCTCTCCC<br>TGTCTCCGGGCAAA (SEQ ID NO: 120) |
| 01G | HC-07 | QVQLVESGGGVVQPGRSLRLSC<br>AASGFTFSSFGMHWVRQAPGKG<br>LEWVAVISFDGSIKYSVDSVKGR<br>FTISRDNSKNTLFLQMNSLRAED<br>TAVYYCARDRLNYYESSGYYH<br>YKYYGMAVWGQGTTVTVSSAS<br>TKGPSVFPLAPSSKSTSGGTAAL<br>GCLVKDYFPEPVTVSWNSGALT<br>SGVHTFPAVLQSSGLYSLESVVT<br>VPSSSLGTQTYICNVNHKPSNTK<br>VDKKVEPKSCDKTHTCPPCPAPE<br>LLGGPSVFLFPPKPKDTLYITREP<br>EVTCVVVDVSHEDPEVKFNWY<br>VDGVEVHNAKTKPCEEQYGSTY<br>RCVSVLTVLHQDWLNGKEYKC<br>KVSNKALPAPIEKTISKAKGQPR<br>EPQVYTLPPSREKMTKNQVSLT<br>CLVKGFYPSDIAVEWESNGQPE<br>NNYKTTPPVLKSDGSFFLYSKLT<br>VDKSRWQQGNVFSCSVMHEAL<br>HNHYTQKSLSLSPGK (SEQ ID<br>NO: 91) | CAGGTGCAGCTGGTGGAATCTGGGGGAGGCGTGG<br>TCCAGCCTGGGAGGTCCCTGAGACTCTCCTGTGC<br>AGCCTCTGGATTCACCTTCAGTAGCTTTGGCATGC<br>ACTGGGTCCGCCAGGCTCCAGGCAAGGGGCTGGA<br>GTGGGTGGCAGTTATCTCATTTGATGGAAGTATTA<br>AGTATTCTGTAGACTCCGTGAAGGGCCGATTCAC<br>CATCTCCAGAGACAATTCAAAGAACACGCTGTTT<br>CTGCAAATGAACAGCCTGCGAGCCGAGGACACGG<br>CTGTGTATTACTGTGCGAGAGATCGGCTCAATTAC<br>TATGAGAGTAGTGGTTATTATCACTACAAATACT<br>ACGGTATGGCCGTCTGGGGCCAAGGGACAACAGT<br>TACCGTGTCTAGTGCCTCCACCAAGGGCCCATCG<br>GTCTTCCCCCTGGCACCCTCCTCCAAGAGCACCTC<br>TGGGGGCACAGCGGCCCTGGGCTGCCTGGTCAAG<br>GACTACTTCCCCGAACCGGTGACGGTGTCGTGGA<br>ACTCAGGCGCCCTGACCAGCGGCGTGCACACCTT<br>CCCGGCTGTCCTACAGTCCTCAGGACTCTACTCCC<br>TCGAGAGCGTGGTGACCGTGCCCTCCAGCAGCTT<br>GGGCACCCAGACCTACATCTGCAACGTGAATCAC<br>AAGCCCAGCAACACCAAGGTGGACAAGAAAGTT<br>GAGCCCAAATCTTGTGACAAAACTCACACATGCC<br>CACCGTGCCCAGCACCTGAACTCCTGGGGGGACC<br>GTCAGTCTTCCTCTTCCCCCCAAAACCCAAGGACA<br>CCCTCTATATCACCCGGGAGCCTGAGGTCACATG<br>CGTGGTGGTGGACGTGAGCCACGAAGACCCTGAG<br>GTCAAGTTCAACTGGTACGTGGACGGCGTGGAGG<br>TGCATAATGCCAAGACAAAGCCGTGCGAGGAGCA<br>GTACGGCAGCACGTACCGTTGCGTCAGCGTCCTC<br>ACCGTCCTGCACCAGGACTGGCTGAATGGCAAGG<br>AGTACAAGTGCAAGGTGTCCAACAAAGCCCTCCC<br>AGCCCCCATCGAGAAAACCATCTCCAAAGCCAAA<br>GGGCAGCCCCGAGAACCACAGGTGTACACCCTGC<br>CCCCATCCCGGGAGAAGATGACCAAGAACCAGGT<br>CAGCCTGACCTGCCTGGTCAAAGGCTTCTATCCCA<br>GCGACATCGCCGTGGAGTGGGAGAGCAATGGGC<br>AGCCGGAGAACAACTACAAGACCACGCCTCCCGT<br>GCTGAAGTCCGACGGCTCCTTCTTCCTCTATAGCA<br>AGCTCACCGTGGACAAGAGCAGGTGGCAGCAGG<br>GGAACGTCTTCTCATGCTCCGTGATGCATGAGGCT<br>CTGCACAACCACTACACGCAGAAGAGCCTCTCCC<br>TGTCTCCGGGCAAA (SEQ ID NO: 121) |
| 03, 04 | HC-08 | QVQLVESGGGVVQPGRSLRLSC<br>AASGFTFSSFGMHWVRQAPGKG<br>LEWVAVISFDGSIKYSVDSVKGR<br>FTISRDNSKNTLFLQMNSLRAED<br>TAVYYCARDRLNYYRSFGYYG<br>YHYYGMAVWGQGTTVTVSSAS<br>TKGPSVFPLAPSSKSTSGGTAAL<br>GCLVKDYFPEPVTVSWNSGALT<br>SGVHTFPAVLQSSGLYSLSSVVT<br>VPSSSLGTQTYICNVNHKPSNTK<br>VDKKVEPKSCDKTHTCPPCPAPE<br>LLGGPSVFLFPPKPKDTLMISRTP<br>EVTCVVVDVSHEDPEVKFNWY<br>VDGVEVHNAKTKPCEEQYGSTY<br>RCVSVLTVLHQDWLNGKEYKC<br>KVSNKALPAPIEKTISKAKGQPR<br>EPQVYTLPPSREEMTKNQVSLTC<br>LVKGFYPSDIAVEWESNGQPEN<br>NYKTTPPVLDSDGSFFLYSKLTV | CAGGTGCAGCTGGTGGAATCTGGGGGAGGCGTGG<br>TCCAGCCTGGGAGGTCCCTGAGACTCTCCTGTGC<br>AGCCTCTGGATTCACCTTCAGTAGCTTTGGCATGC<br>ACTGGGTCCGCCAGGCTCCAGGCAAGGGGCTGGA<br>GTGGGTGGCAGTTATATCATTTGATGGAAGTATT<br>AAGTATTCTGTAGACTCCGTGAAGGGCCGATTCA<br>CCATCTCCAGAGACAATTCAAAGAACACGCTGTT<br>TCTGCAAATGAACAGCCTGCGAGCCGAGGACACG<br>GCTGTGTATTACTGTGCGAGAGATCGGCTCAACT<br>ACTATCGTAGTTTCGGTTATTATGGTTACCATTAC<br>TACGGTATGGCCGTCTGGGGCCAAGGGACAACAG<br>TTACCGTGTCTAGTGCCTCCACCAAGGGCCCATCG<br>GTCTTCCCCCTGGCACCCTCCTCCAAGAGCACCTC<br>TGGGGGCACAGCGGCCCTGGGCTGCCTGGTCAAG<br>GACTACTTCCCCGAACCGGTGACGGTGTCGTGGA<br>ACTCAGGCGCCCTGACCAGCGGCGTGCACACCTT<br>CCCGGCTGTCCTACAGTCCTCAGGACTCTACTCCC<br>TCAGCAGCGTGGTGACCGTGCCCTCCAGCAGCTT<br>GGGCACCCAGACCTACATCTGCAACGTGAATCAC |

TABLE 5B-continued

| Exemplary Anti-CGRP Receptor Antibody Heavy Chain Sequences | | | |
|---|---|---|---|
| Antibody ID. | HC Group | Heavy Chain Amino Acid Sequence | Heavy Chain Nucleic Acid Sequence |
| | | DKSRWQQGNVFSCSVMHEALH NHYTQKSLSLSPGK (SEQ ID NO: 92) | AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TCAAGTTCAACTGGTACGTGGACGGCGTGGAGGT GCATAATGCCAAGACAAAGCCGTGCGAGGAGCA GTACGGCAGCACGTACCGTTGCGTCAGCGTCCTC ACCGTCCTGCACCAGGACTGGCTGAATGGCAAGG AGTACAAGTGCAAGGTGTCCAACAAAGCCCTCCC AGCCCCCATCGAGAAAACCATCTCCAAAGCCAAA GGGCAGCCCCGAGAACCACAGGTGTACACCCTGC CCCCATCCCGGGAGGAGATGACCAAGAACCAGGT CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT GCTGGACTCCGACGGCTCCTTCTTCCTCTATAGCA AGCTCACCGTGGACAAGAGCAGGTGGCAGCAGG GGAACGTCTTCTCATGCTCCGTGATGCATGAGGCT CTGCACAACCACTACACGCAGAAGAGCCTCTCCC TGTCTCCGGGTAAA (SEQ ID NO: 122) |
| 03A | HC-09 | QVQLVESGGGVVQPGRSLRLSC AASGFTFSSFGMHWVRQAPGKG LEWVAVISFDGSIKYSVDSVKGR FTISRDNSKNTLFLQMNSLRAED TAVYYCARDRLNYYRSFGYYG YHYYGMAVWGQGTTVTVSSAS TKGPSVFPLAPSSKSTSGGTAAL GCLVKDYFPEPVTVSWNSGALT SGVHTFPAVLQSSGLYSLESVVT VPSSSLGTQTYICNVNHKPSNTK VDKKVEPKSCDKTHTCPPCPAPE LLGGPSVFLFPPKPKDTLMISRTP EVTCVVVDVSHEDPEVKFNWY VDGVEVHNAKTKPCEEQYGSTY RCVSVLTVLHQDWLNGKEYKC KVSNKALPAPIEKTISKAKGQPR EPQVYTLPPSRKEMTKNQVSLT CLVKGFYPSDIAVEWESNGQPE NNYKTTPPVLKSDGSFFLYSKLT VDKSRWQQGNVFSCSVMHEAL HNHYTQKSLSLSPGK (SEQ ID NO: 93) | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATCTCATTTGATGGAAGTATTA AGTATTCTGTAGACTCCGTGAAGGGCCGATTCAC CATCTCCAGAGACAATTCAAAGAACACGCTGTTT CTGCAAATGAACAGCCTGCGAGCCGAGGACACGG CTGTGTATTACTGTGCGAGAGATCGGCTCAACTA CTATCGTAGTTTCGGTTATTATGGTTACCATTACT ACGGTATGGCCGTCTGGGGCCAAGGGACAACAGT TACCGTGTCTAGTGCCTCCACCAAGGGCCCATCG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCGAGAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TCAAGTTCAACTGGTACGTGGACGGCGTGGAGGT GCATAATGCCAAGACAAAGCCGTGCGAGGAGCA GTACGGCAGCACGTACCGTTGCGTCAGCGTCCTC ACCGTCCTGCACCAGGACTGGCTGAATGGCAAGG AGTACAAGTGCAAGGTGTCCAACAAAGCCCTCCC AGCCCCCATCGAGAAAACCATCTCCAAAGCCAAA GGGCAGCCCCGAGAACCACAGGTGTACACCCTGC CCCCATCCCGGAAGGAGATGACCAAGAACCAGGT CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT GCTGAAGTCCGACGGCTCCTTCTTCCTCTATAGCA AGCTCACCGTGGACAAGAGCAGGTGGCAGCAGG GGAACGTCTTCTCATGCTCCGTGATGCATGAGGCT CTGCACAACCACTACACGCAGAAGAGCCTCTCCC TGTCTCCGGGTAAA (SEQ ID NO: 123) |
| 03B | HC-10 | QVQLVESGGGVVQPGRSLRLSC AASGFTFSSFGMHWVRQAPGKG LEWVAVISFDGSIKYSVDSVKGR FTISRDNSKNTLFLQMNSLRAED TAVYYCARDRLNYYRSFGYYG YHYYGMAVWGQGTTVTVSSAS TKGPSVFPLAPSSKSTSGGTAAL GCLVKDYFPEPVTVSWNSGALT SGVHTFPAVLQSSGLYSLESVVT VPSSSLGTQTYICNVNHKPSNTK | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATCTCATTTGATGGAAGTATTA AGTATTCTGTAGACTCCGTGAAGGGCCGATTCAC CATCTCCAGAGACAATTCAAAGAACACGCTGTTT CTGCAAATGAACAGCCTGCGAGCCGAGGACACGG CTGTGTATTACTGTGCGAGAGATCGGCTCAACTA CTATCGTAGTTTCGGTTATTATGGTTACCATTACT |

TABLE 5B-continued

Exemplary Anti-CGRP Receptor Antibody Heavy Chain Sequences

| Antibody ID. | HC Group | Heavy Chain Amino Acid Sequence | Heavy Chain Nucleic Acid Sequence |
|---|---|---|---|
| | | VDKKVEPKSCDKTHTCPPCPAPE<br>LLGGPSVFLFPPKPKDTLMISRTP<br>EVTCVVVDVSHEDPEVKFNWY<br>VDGVEVHNAKTKPCEEQYGSTY<br>RCVSVLTVLHQDWLNGKEYKC<br>KVSNKALPAPIEKTISKAKGQPR<br>EPQVYTLPPSRKKMTKNQVSLT<br>CLVKGFYPSDIAVEWESNGQPE<br>NNYKTTPPVLKSDGSFFLYSKLT<br>VDKSRWQQGNVFSCSVMHEAL<br>HNHYTQKSLSLSPGK (SEQ ID<br>NO: 94) | ACGGTATGGCCGTCTGGGGCCAAGGGACAACAGT<br>TACCGTGTCTAGTGCCTCCACCAAGGGCCCATCG<br>GTCTTCCCCCTGGCACCCTCCTCCAAGAGCACCTC<br>TGGGGGCACAGCGGCCCTGGGCTGCCTGGTCAAG<br>GACTACTTCCCCGAACCGGTGACGGTGTCGTGGA<br>ACTCAGGCGCCCTGACCAGCGGCGTGCACACCTT<br>CCCGGCTGTCCTACAGTCCTCAGGACTCTACTCCC<br>TCGAGAGCGTGGTGACCGTGCCCTCCAGCAGCTT<br>GGGCACCCAGACCTACATCTGCAACGTGAATCAC<br>AAGCCCAGCAACACCAAGGTGGACAAGAAAGTT<br>GAGCCCAAATCTTGTGACAAAACTCACACATGCC<br>CACCGTGCCCAGCACCTGAACTCCTGGGGGGACC<br>GTCAGTCTTCCTCTTCCCCCCAAAACCCAAGGACA<br>CCCTCATGATCTCCCGGACCCCTGAGGTCACATGC<br>GTGGTGGTGGACGTGAGCCACGAAGACCCTGAGG<br>TCAAGTTCAACTGGTACGTGGACGGCGTGGAGGT<br>GCATAATGCCAAGACAAAGCCGTGCGAGGAGCA<br>GTACGGCAGCACGTACCGTTGCGTCAGCGTCCTC<br>ACCGTCCTGCACCAGGACTGGCTGAATGGCAAGG<br>AGTACAAGTGCAAGGTGTCCAACAAAGCCCTCCC<br>AGCCCCCATCGAGAAAACCATCTCCAAAGCCAAA<br>GGGCAGCCCCGAGAACCACAGGTGTACACCCTGC<br>CCCCATCCCGGAAGAAGATGACCAAGAACCAGGT<br>CAGCCTGACCTGCCTGGTCAAAGGCTTCTATCCCA<br>GCGACATCGCCGTGGAGTGGGAGAGCAATGGGC<br>AGCCGGAGAACAACTACAAGACCACGCCTCCCGT<br>GCTGAAGTCCGACGGCTCCTTCTTCCTCTATAGCA<br>AGCTCACCGTGGACAAGAGCAGGTGGCAGCAGG<br>GGAACGTCTTCTCATGCTCCGTGATGCATGAGGCT<br>CTGCACAACCACTACACGCAGAAGAGCCTCTCCC<br>TGTCTCCGGGTAAA (SEQ ID NO: 124) |
| 07 | HC-11 | QVQLVESGGGVVQPGRSLRLSC<br>AASGFYFMTYGMHWVRQAPGK<br>GLEWVAVISFDGSIKYSVDSVKG<br>RFTISRDNSKNTLFLQMNSLRAE<br>DTAVYYCARDRLNYYESSGYY<br>HYKYYGMAVWGQGTTVTVSSA<br>STKGPSVFPLAPSSKSTSGGTAA<br>LGCLVKDYFPEPVTVSWNSGAL<br>TSGVHTFPAVLQSSGLYSLSSVV<br>TVPSSSLGTQTYICNVNHKPSNT<br>KVDKKVEPKSCDKTHTCPPCPA<br>PELLGGPSVFLFPPKPKDTLMISR<br>TPEVTCVVVDVSHEDPEVKFNW<br>YVDGVEVHNAKTKPCEEQYGST<br>YRCVSVLTVLHQDWLNGKEYK<br>CKVSNKALPAPIEKTISKAKGQP<br>REPQVYTLPPSREEMTKNQVSLT<br>CLVKGFYPSDIAVEWESNGQPE<br>NNYKTTPPVLDSDGSFFLYSKLT<br>VDKSRWQQGNVFSCSVMHEAL<br>HNHYTQKSLSLSPGK (SEQ ID<br>NO: 95) | CAGGTGCAGCTGGTGGAATCTGGGGGAGGCGTGG<br>TCCAGCCTGGGAGGTCCCTGAGACTCTCCTGTGC<br>AGCCTCTGGATTCTACTTCATGACTTATGGTATGC<br>ACTGGGTCCGCCAGGCTCCAGGCAAGGGGCTGGA<br>GTGGGTGGCAGTTATATCATTTGATGGGAGTATT<br>AAGTATTCTGTAGACTCCGTGAAGGGCCGATTCA<br>CCATCTCCAGAGACAATTCAAAGAACACGCTGTT<br>TCTGCAAATGAACAGCCTGCGAGCCGAGGACACG<br>GCTGTGTATTACTGTGCGAGAGATCGGCTCAATT<br>ACTATGAGAGTAGTGGTTATTATCACTACAAATA<br>CTACGGTATGGCCGTCTGGGGCCAAGGGACAACA<br>GTTACCGTGTCTAGTGCCTCCACCAAGGGCCCATC<br>GGTCTTCCCCCTGGCACCCTCCTCCAAGAGCACCT<br>CTGGGGGCACAGCGGCCCTGGGCTGCCTGGTCAA<br>GGACTACTTCCCCGAACCGGTGACGGTGTCGTGG<br>AACTCAGGCGCCCTGACCAGCGGCGTGCACACCT<br>TCCCGGCTGTCCTACAGTCCTCAGGACTCTACTCC<br>CTCAGCAGCGTGGTGACCGTGCCCTCCAGCAGCT<br>TGGGCACCCAGACCTACATCTGCAACGTGAATCA<br>CAAGCCCAGCAACACCAAGGTGGACAAGAAAGT<br>TGAGCCCAAATCTTGTGACAAAACTCACACATGC<br>CCACCGTGCCCAGCACCTGAACTCCTGGGGGGAC<br>CGTCAGTCTTCCTCTTCCCCCCAAAACCCAAGGAC<br>ACCCTCATGATCTCCCGGACCCCTGAGGTCACAT<br>GCGTGGTGGTGGACGTGAGCCACGAAGACCCTGA<br>GGTCAAGTTCAACTGGTACGTGGACGGCGTGGAG<br>GTGCATAATGCCAAGACAAAGCCGTGCGAGGAGC<br>AGTACGGCAGCACGTACCGTTGCGTCAGCGTCCT<br>CACCGTCCTGCACCAGGACTGGCTGAATGGCAAG<br>GAGTACAAGTGCAAGGTGTCCAACAAAGCCCTCC<br>CAGCCCCCATCGAGAAAACCATCTCCAAAGCCAA<br>AGGGCAGCCCCGAGAACCACAGGTGTACACCCTG<br>CCCCCATCCCGGGAGGAGATGACCAAGAACCAGG<br>TCAGCCTGACCTGCCTGGTCAAAGGCTTCTATCCC<br>AGCGACATCGCCGTGGAGTGGGAGAGCAATGGG<br>CAGCCGGAGAACAACTACAAGACCACGCCTCCCG<br>TGCTGGACTCCGACGGCTCCTTCTTCCTCTATAGC<br>AAGCTCACCGTGGACAAGAGCAGGTGGCAGCAG<br>GGGAACGTCTTCTCATGCTCCGTGATGCATGAGG<br>CTCTGCACAACCACTACACGCAGAAGAGCCTCTC<br>CCTGTCTCCGGGTAAA (SEQ ID NO: 125) |

TABLE 5B-continued

Exemplary Anti-CGRP Receptor Antibody Heavy Chain Sequences

| Antibody ID. | HC Group | Heavy Chain Amino Acid Sequence | Heavy Chain Nucleic Acid Sequence |
|---|---|---|---|
| 09 | HC-12 | QVQLVESGGGVVQPGRSLRLSC<br>AASGFTFSSFGMHWVRQAPGKG<br>LEWVAVISFAGEIDYYVDSVKG<br>RFTISRDNSKNTLFLQMNSLRAE<br>DTAVYYCARDRLNYYESSGYY<br>HYKYYGMAVWGQGTTVTVSSA<br>STKGPSVFPLAPSSKSTSGGTAA<br>LGCLVKDYFPEPVTVSWNSGAL<br>TSGVHTFPAVLQSSGLYSLSSVV<br>TVPSSSLGTQTYICNVNHKPSNT<br>KVDKKVEPKSCDKTHTCPPCPA<br>PELLGGPSVFLFPPKPKDTLMISR<br>TPEVTCVVVDVSHEDPEVKFNW<br>YVDGVEVHNAKTKPCEEQYGST<br>YRCVSVLTVLHQDWLNGKEYK<br>CKVSNKALPAPIEKTISKAKGQP<br>REPQVYTLPPSREEMTKNQVSLT<br>CLVKGFYPSDIAVEWESNGQPE<br>NNYKTTPPVLDSDGSFFLYSKLT<br>VDKSRWQQGNVFSCSVMHEAL<br>HNHYTQKSLSLSPGK (SEQ ID<br>NO: 96) | CAGGTGCAGCTGGTGGAATCTGGGGGAGGCGTGG<br>TCCAGCCTGGGAGGTCCCTGAGACTCTCCTGTGC<br>AGCCTCTGGATTCACCTTCAGTAGCTTTGGCATGC<br>ACTGGGTCCGCCAGGCTCCAGGCAAGGGGCTGGA<br>GTGGGTGGCAGTTATATCATTTGCTGGAGAAATC<br>GACTACTACGTAGACTCCGTGAAGGGCCGATTCA<br>CCATCTCCAGAGACAATTCAAAGAACACGCTGTT<br>TCTGCAAATGAACAGCCTGCGAGCCGAGGACACG<br>GCTGTGTATTACTGTGCGAGAGATCGGCTCAATT<br>ACTATGAGAGTAGTGGTTATTATCACTACAAATA<br>CTACGGTATGGCCGTCTGGGGCCAAGGGACAACA<br>GTTACCGTGTCTAGTGCCTCCACCAAGGGCCCATC<br>GGTCTTCCCCCTGGCACCCTCCTCCAAGAGCACCT<br>CTGGGGGCACAGCGGCCCTGGGCTGCCTGGTCAA<br>GGACTACTTCCCCGAACCGGTGACGGTGTCGTGG<br>AACTCAGGCGCCCTGACCAGCGGCGTGCACACCT<br>TCCCGGCTGTCCTACAGTCCTCAGGACTCTACTCC<br>CTCAGCAGCGTGGTGACCGTGCCCTCCAGCAGCT<br>TGGGCACCCAGACCTACATCTGCAACGTGAATCA<br>CAAGCCCAGCAACACCAAGGTGGACAAGAAAGT<br>TGAGCCCAAATCTTGTGACAAAACTCACACATGC<br>CCACCGTGCCCAGCACCTGAACTCCTGGGGGGAC<br>CGTCAGTCTTCCTCTTCCCCCCAAAACCCAAGGAC<br>ACCCTCATGATCTCCCGGACCCCTGAGGTCACAT<br>GCGTGGTGGTGGACGTGAGCCACGAAGACCCTGA<br>GGTCAAGTTCAACTGGTACGTGGACGGCGTGGAG<br>GTGCATAATGCCAAGACAAAGCCGTGCGAGGAGC<br>AGTACGGCAGCACGTACCGTTGCGTCAGCGTCCT<br>CACCGTCCTGCACCAGGACTGGCTGAATGGCAAG<br>GAGTACAAGTGCAAGGTGTCCAACAAAGCCCTCC<br>CAGCCCCCATCGAGAAAACCATCTCCAAAGCCAA<br>AGGGCAGCCCCGAGAACCACAGGTGTACACCCTG<br>CCCCCATCCCGGGAGGAGATGACCAAGAACCAGG<br>TCAGCCTGACCTGCCTGGTCAAAGGCTTCTATCCC<br>AGCGACATCGCCGTGGAGTGGGAGAGCAATGGG<br>CAGCCGGAGAACAACTACAAGACCACGCCTCCCG<br>TGCTGGACTCCGACGGCTCCTTCTTCCTCTATAGC<br>AAGCTCACCGTGGACAAGAGCAGGTGGCAGCAG<br>GGGAACGTCTTCTCATGCTCCGTGATGCATGAGG<br>CTCTGCACAACCACTACACGCAGAAGAGCCTCTC<br>CCTGTCTCCGGGTAAA (SEQ ID NO: 126) |
| 10 | HC-13 | QVQLVESGGGVVQPGRSLRLSC<br>AASGFFFGSYGMHWVRQAPGK<br>GLEWVAVISFAGEIEHYVDSVK<br>GRFTISRDNSKNTLFLQMNSLRA<br>EDTAVYYCARDRLNYYESSGYY<br>HYKYYGMAVWGQGTTVTVSSA<br>STKGPSVFPLAPSSKSTSGGTAA<br>LGCLVKDYFPEPVTVSWNSGAL<br>TSGVHTFPAVLQSSGLYSLSSVV<br>TVPSSSLGTQTYICNVNHKPSNT<br>KVDKKVEPKSCDKTHTCPPCPA<br>PELLGGPSVFLFPPKPKDTLMISR<br>TPEVTCVVVDVSHEDPEVKFNW<br>YVDGVEVHNAKTKPCEEQYGST<br>YRCVSVLTVLHQDWLNGKEYK<br>CKVSNKALPAPIEKTISKAKGQP<br>REPQVYTLPPSREEMTKNQVSLT<br>CLVKGFYPSDIAVEWESNGQPE<br>NNYKTTPPVLDSDGSFFLYSKLT<br>VDKSRWQQGNVFSCSVMHEAL<br>HNHYTQKSLSLSPGK (SEQ ID<br>NO: 97) | CAGGTGCAGCTGGTGGAATCTGGGGGAGGCGTGG<br>TCCAGCCTGGGAGGTCCCTGAGACTCTCCTGTGC<br>AGCCTCTGGATTCTTCTTCGGTTCTTATGGTATGC<br>ACTGGGTCCGCCAGGCTCCAGGCAAGGGGCTGGA<br>GTGGGTGGCAGTTATATCATTTGCTGGAGAAATC<br>GAACATTACGTAGACTCCGTGAAGGGCCGATTCA<br>CCATCTCCAGAGACAATTCAAAGAACACGCTGTT<br>TCTGCAAATGAACAGCCTGCGAGCCGAGGACACG<br>GCTGTGTATTACTGTGCGAGAGATCGGCTCAATT<br>ACTATGAGAGTAGTGGTTATTATCACTACAAATA<br>CTACGGTATGGCCGTCTGGGGCCAAGGGACAACA<br>GTTACCGTGTCTAGTGCCTCCACCAAGGGCCCATC<br>GGTCTTCCCCCTGGCACCCTCCTCCAAGAGCACCT<br>CTGGGGGCACAGCGGCCCTGGGCTGCCTGGTCAA<br>GGACTACTTCCCCGAACCGGTGACGGTGTCGTGG<br>AACTCAGGCGCCCTGACCAGCGGCGTGCACACCT<br>TCCCGGCTGTCCTACAGTCCTCAGGACTCTACTCC<br>CTCAGCAGCGTGGTGACCGTGCCCTCCAGCAGCT<br>TGGGCACCCAGACCTACATCTGCAACGTGAATCA<br>CAAGCCCAGCAACACCAAGGTGGACAAGAAAGT<br>TGAGCCCAAATCTTGTGACAAAACTCACACATGC<br>CCACCGTGCCCAGCACCTGAACTCCTGGGGGGAC<br>CGTCAGTCTTCCTCTTCCCCCCAAAACCCAAGGAC<br>ACCCTCATGATCTCCCGGACCCCTGAGGTCACAT<br>GCGTGGTGGTGGACGTGAGCCACGAAGACCCTGA<br>GGTCAAGTTCAACTGGTACGTGGACGGCGTGGAG<br>GTGCATAATGCCAAGACAAAGCCGTGCGAGGAGC<br>AGTACGGCAGCACGTACCGTTGCGTCAGCGTCCT<br>CACCGTCCTGCACCAGGACTGGCTGAATGGCAAG<br>GAGTACAAGTGCAAGGTGTCCAACAAAGCCCTCC<br>CAGCCCCCATCGAGAAAACCATCTCCAAAGCCAA<br>AGGGCAGCCCCGAGAACCACAGGTGTACACCCTG |

TABLE 5B-continued

Exemplary Anti-CGRP Receptor Antibody Heavy Chain Sequences

| Antibody ID. | HC Group | Heavy Chain Amino Acid Sequence | Heavy Chain Nucleic Acid Sequence |
|---|---|---|---|
| | | | CCCCCATCCCGGGAGGAGATGACCAAGAACCAGG TCAGCCTGACCTGCCTGGTCAAAGGCTTCTATCCC AGCGACATCGCCGTGGAGTGGGAGAGCAATGGG CAGCCGGAGAACAACTACAAGACCACGCCTCCCG TGCTGGACTCCGACGGCTCCTTCTTCCTCTATAGC AAGCTCACCGTGGACAAGAGCAGGTGGCAGCAG GGGAACGTCTTCTCATGCTCCGTGATGCATGAGG CTCTGCACAACCACTACACGCAGAAGAGCCTCTC CCTGTCTCCGGGTAAA (SEQ ID NO: 127) |
| 11 | HC-14 | QVQLVESGGGVVQPGRSLRLSC AASGFWFDTFGMHWVRQAPGK GLEWVAVISFAGEDTHYVDSVK GRFTISRDNSKNTLFLQMNSLRA EDTAVYYCARDRLNYYESYGY YGYHYYGMAVWGQGTTVTVSS ASTKGPSVFPLAPSSKSTSGGTA ALGCLVKDYFPEPVTVSWNSGA LTSGVHTFPAVLQSSGLYSLSSV VTVPSSSLGTQTYICNVNHKPSN TKVDKKVEPKSCDKTHTCPPCP APELLGGPSVFLFPPKPKDTLMIS RTPEVTCVVVDVSHEDPEVKFN WYVDGVEVHNAKTKPCEEQYG STYRCVSVLTVLHQDWLNGKEY KCKVSNKALPAPIEKTISKAKGQ PREPQVYTLPPSREEMTKNQVSL TCLVKGFYPSDIAVEWESNGQPE NNYKTTPPVLDSDGSFFLYSKLT VDKSRWQQGNVFSCSVMHEAL HNHYTQKSLSLSPGK (SEQ ID NO: 98) | CAGGTGCAGCTGGTGGAATCTGGGGGAGGCGTGG TCCAGCCTGGGAGGTCCCTGAGACTCTCCTGTGC AGCCTCTGGATTCTGGTTCGACACTTTTGGTATGC ACTGGGTCCGCCAGGCTCCAGGCAAGGGGCTGGA GTGGGTGGCAGTTATATCATTTGCTGGAGAAGAC ACTCATTACGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAACT ACTATGAAAGTTACGGTTATTATGGTTACCATTAC TACGGTATGGCCGTCTGGGGCCAAGGGACAACAG TTACCGTGTCTAGTGCCTCCACCAAGGGCCCATCG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCAGCAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TCAAGTTCAACTGGTACGTGGACGGCGTGGAGGT GCATAATGCCAAGACAAAGCCGTGCGAGGAGCA GTACGGCAGCACGTACCGTTGCGTCAGCGTCCTC ACCGTCCTGCACCAGGACTGGCTGAATGGCAAGG AGTACAAGTGCAAGGTGTCCAACAAAGCCCTCCC AGCCCCCATCGAGAAAACCATCTCCAAAGCCAAA GGGCAGCCCCGAGAACCACAGGTGTACACCCTGC CCCCATCCCGGGAGGAGATGACCAAGAACCAGGT CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT GCTGGACTCCGACGGCTCCTTCTTCCTCTATAGCA AGCTCACCGTGGACAAGAGCAGGTGGCAGCAGG GGAACGTCTTCTCATGCTCCGTGATGCATGAGGCT CTGCACAACCACTACACGCAGAAGAGCCTCTCCC TGTCTCCGGGTAAA (SEQ ID NO: 128) |

In certain embodiments, the anti-CGRP receptor antibodies, antigen-binding fragments, antigen binding proteins or binding domains thereof of the invention may comprise a light chain selected from LC-01 to LC-16, as shown in Table 5A, and/or a heavy chain selected from HC-01 to HC-14, as shown in Table 5B, and variants of these light chains and heavy chains. Each of the light chains listed in Table 5A may be combined with any of the heavy chains listed in Table 5B to form an anti-CGRP receptor antibody or antigen-binding fragment thereof of the invention or an anti-CGRP receptor binding domain of a bispecific antigen binding protein of the invention. For example, in certain embodiments, the anti-CGRP receptor antibodies, antigen-binding fragments, antigen binding proteins or binding domains thereof of the invention comprise a light chain comprising the sequence of LC-03 (SEQ ID NO: 71) and a heavy chain comprising the sequence of HC-02 (SEQ ID NO: 86). In some embodiments, the anti-CGRP receptor antibodies, antigen-binding fragments, antigen binding proteins or binding domains thereof of the invention comprise a light chain comprising the sequence of LC-05 (SEQ ID NO: 73) and a heavy chain comprising the sequence of HC-02 (SEQ ID NO: 86). In other embodiments, the anti-CGRP receptor antibodies, antigen-binding fragments, antigen binding proteins or binding domains thereof of the invention comprise a light chain comprising the sequence of LC-07 (SEQ ID NO: 75) and a heavy chain comprising the sequence of HC-08 (SEQ ID NO: 92). In still other embodiments, the anti-CGRP receptor antibodies, antigen-binding fragments, antigen binding proteins or binding domains thereof of the invention comprise a light chain comprising the sequence of LC-02 (SEQ ID NO: 70) and a heavy chain comprising the sequence of HC-08 (SEQ ID NO: 92). In some embodiments, the anti-CGRP receptor antibodies, antigen-binding fragments, antigen binding proteins or binding domains thereof of the invention comprise a light chain comprising the sequence of LC-09 (SEQ ID NO: 77) and a heavy chain comprising the sequence of HC-02 (SEQ ID NO: 86). In certain embodiments, the anti-CGRP receptor antibodies, antigen-binding fragments, antigen binding proteins or binding domains thereof of the invention comprise a light chain comprising the sequence of LC-10 (SEQ ID NO: 78) and a heavy chain comprising the sequence of HC-02 (SEQ ID NO: 86). In one embodiment, the anti-CGRP receptor antibodies, antigen-binding fragments, antigen binding proteins or binding domains thereof of the invention comprise a light chain comprising the sequence of LC-02 (SEQ ID NO: 70) and a heavy chain comprising the sequence of HC-11 (SEQ ID NO: 95). In another embodiment, the anti-CGRP receptor antibodies, antigen-binding fragments, antigen binding proteins or binding domains thereof of the invention comprise a light chain comprising the sequence of LC-11 (SEQ ID NO: 79) and a heavy chain comprising the sequence of HC-02 (SEQ ID NO: 86). In yet another embodiment, the anti-CGRP receptor antibodies, antigen-binding fragments, antigen binding proteins or binding domains thereof of the invention comprise a light chain comprising the sequence of LC-02 (SEQ ID NO: 70) and a heavy chain comprising the sequence of HC-12 (SEQ ID NO: 96). In still another embodiment, the anti-CGRP receptor antibodies, antigen-binding fragments, antigen binding proteins or binding domains thereof of the invention comprise a light chain comprising the sequence of LC-02 (SEQ ID NO: 70) and a heavy chain comprising the sequence of HC-13 (SEQ ID NO: 97).

In certain other embodiments, the anti-CGRP receptor antibodies, antigen-binding fragments, antigen binding proteins or binding domains thereof of the invention comprise a light chain comprising the sequence of LC-12 (SEQ ID NO: 80) and a heavy chain comprising the sequence of HC-14 (SEQ ID NO: 98). In some embodiments, the anti-CGRP receptor antibodies, antigen-binding fragments, antigen binding proteins or binding domains thereof of the invention comprise a light chain comprising the sequence of LC-13 (SEQ ID NO: 81) and a heavy chain comprising the sequence of HC-02 (SEQ ID NO: 86). In other embodiments, the anti-CGRP receptor antibodies, antigen-binding fragments, antigen binding proteins or binding domains thereof of the invention comprise a light chain comprising the sequence of LC-14 (SEQ ID NO: 82) and a heavy chain comprising the sequence of HC-02 (SEQ ID NO: 86). In still other embodiments, the anti-CGRP receptor antibodies, antigen-binding fragments, antigen binding proteins or binding domains thereof of the invention comprise a light chain comprising the sequence of LC-15 (SEQ ID NO: 83) and a heavy chain comprising the sequence of HC-02 (SEQ ID NO: 86). In some embodiments, the anti-CGRP receptor antibodies, antigen-binding fragments, antigen binding proteins or binding domains thereof of the invention comprise a light chain comprising the sequence of LC-16 (SEQ ID NO: 84) and a heavy chain comprising the sequence of HC-02 (SEQ ID NO: 86).

In certain embodiments, the anti-CGRP receptor antibodies, antigen-binding fragments, antigen binding proteins or binding domains thereof comprise a light chain comprising a sequence of contiguous amino acids that differs from the sequence of a light chain in Table 5A, i.e. a light chain selected from LC-01 to LC-16, at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing light chain sequences. The light chain in some anti-CGRP receptor antibodies, antigen-binding fragments, antigen binding proteins, or binding domains thereof comprises a sequence of amino acids that has at least 70%, at least 75%, at least 80%, at least 85%, at least 90%, at least 95%, at least 97% or at least 99% sequence identity to the amino acid sequences of SEQ ID NOs: 69 to 84 (i.e. the light chains in Table 5A).

In these and other embodiments, the anti-CGRP receptor antibodies, antigen-binding fragments, antigen binding proteins or binding domains thereof comprise a heavy chain comprising a sequence of contiguous amino acids that differs from the sequence of a heavy chain in Table 5B, i.e., a heavy chain selected from HC-01 to HC-14, at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing heavy chain sequences. The heavy chain in some anti-CGRP receptor antibodies, antigen-binding fragments, antigen binding proteins or binding domains thereof comprises a sequence of amino acids that has at least 70%, at least 75%, at least 80%, at least 85%, at least 90%, at least 95%, at least 97% or at least 99% sequence identity to the amino acid sequences of SEQ ID NOs: 85 to 98 (i.e. the heavy chains in Table 5B).

The anti-CGRP receptor antibodies, antigen-binding fragments, or antigen binding proteins of the invention can be monoclonal antibodies, recombinant antibodies, human antibodies, humanized antibodies, chimeric antibodies, or antigen-binding fragments of any of the foregoing. In certain embodiments, the anti-CGRP receptor antibody, antigen-binding fragment, or antigen binding protein is a monoclonal antibody or antigen-binding fragment thereof. In such embodiments, the anti-CGRP receptor antibody, antigen-binding fragment, or antigen binding protein may be a chimeric antibody, a humanized antibody, or a fully human antibody having a human immunoglobulin constant domain or an antigen-binding fragment of any of the foregoing. In these and other embodiments, the anti-CGRP receptor antibody, antigen-binding fragment, or antigen binding protein is a human IgG1, IgG2, IgG3, or IgG4 antibody or antigen-binding fragment thereof. Thus, the anti-CGRP receptor antibody, antigen-binding fragment, or antigen binding protein may, in some embodiments, have a human IgG1, IgG2, IgG3, or IgG4 constant domain. In one embodiment, the anti-CGRP receptor antibody, antigen-binding fragment, or antigen binding protein is a monoclonal human IgG1 antibody or antigen-binding fragment thereof. In another embodiment, the anti-CGRP receptor antibody, antigen-binding fragment, or antigen binding protein is a monoclonal human IgG2 antibody or antigen-binding fragment thereof. In yet another embodiment, the anti-CGRP receptor antibody, antigen-binding fragment, or antigen binding protein is a monoclonal human IgG4 antibody or antigen-binding fragment thereof.

The term “monoclonal antibody” (or “mAb”) as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against an individual antigenic site or epitope, in contrast to polyclonal antibody preparations that typically include different antibodies directed against different epitopes. Monoclonal antibodies may be produced using any technique known in the art, e.g., by immortalizing spleen cells harvested from an animal after completion of the immunization schedule. The spleen cells can be immortalized using any technique known in the art, e.g., by fusing them with myeloma cells to produce hybridomas. See, for example, Antibodies; Harlow and Lane, Cold Spring Harbor Laboratory Press, 1st Edition, e.g. from 1988, or 2nd Edition, e.g. from 2014. Myeloma cells for use in hybridoma-producing fusion procedures preferably are non-antibody-producing, have high fusion efficiency, and enzyme deficiencies that render them incapable of growing in certain selective media, which support the growth of only the desired fused cells (hybridomas). Examples of suitable cell lines for use in fusions with mouse cells include, but are not limited to, Sp-20, P3-X63/Ag8, P3-X63-Ag8.653, NS1/1.Ag 4 1, Sp210-Ag14, FO, NSO/U, MPC-11, MPC11-X45-GTG 1.7 and S194/5XXO Bul. Examples of suitable cell lines used for fusions with rat cells include, but are not limited to, R210.RCY3, Y3-Ag 1.2.3, IR983F and 4B210. Other cell lines useful for cell fusions are U-266, GM1500-GRG2, LICR-LON-HMy2 and UC729-6.

In some instances, a hybridoma cell line is produced by immunizing an animal (e.g., a rabbit, rat, mouse, or a transgenic animal having human immunoglobulin sequences) with a CGRP receptor immunogen (see, e.g., WO 2010/075238); harvesting spleen cells from the immunized animal; fusing the harvested spleen cells to a myeloma cell line, thereby generating hybridoma cells; establishing hybridoma cell lines from the hybridoma cells, and identifying a hybridoma cell line that produces an antibody that binds to CGRP receptor. Another useful method for producing monoclonal antibodies is the SLAM method described in Babcook et al., Proc. Natl. Acad. Sci. USA, Vol. 93: 7843-7848, 1996.

Monoclonal antibodies secreted by a hybridoma cell line can be purified using any technique known in the art, such as protein A-Sepharose, hydroxyapatite chromatography, gel electrophoresis, dialysis, or affinity chromatography. Hybridoma supernatants or mAbs may be further screened to identify mAbs with particular properties, such as the ability to bind CGRP receptor (e.g. human CGRP receptor, cynomolgus monkey CGRP receptor, or rat CGRP receptor); cross-reactivity to other calcitonin receptor family members (e.g. human adrenomedullin or human amylin receptors); ability to block or interfere with the binding of the CGRP ligand to CGRP receptor, or the ability to functionally block CGRP-induced activation of the CGRP receptor, e.g., using a cAMP assay as described herein.

In some embodiments, the anti-CGRP receptors antibodies, antigen-binding fragments, or antigen binding proteins of the invention are chimeric or humanized antibodies or antigen-binding fragments thereof based upon the CDR and variable region sequences of the antibodies described herein. A chimeric antibody is an antibody composed of protein segments from different antibodies that are covalently joined to produce functional immunoglobulin light or heavy chains or binding fragments thereof. Generally, a portion of the heavy chain and/or light chain is identical with or homologous to a corresponding sequence in antibodies derived from a particular species or belonging to a particular antibody class or subclass, while the remainder of the chain(s) is/are identical with or homologous to a corresponding sequence in antibodies derived from another species or belonging to another antibody class or subclass. For methods relating to chimeric antibodies, see, for example, U.S. Pat. No. 4,816,567 and Morrison et al., 1985, Proc. Natl. Acad. Sci. USA 81:6851-6855, both of which are hereby incorporated by reference in their entireties.

Generally, the goal of making a chimeric antibody is to create a chimera in which the number of amino acids from the intended species or germline gene is maximized. One example is the "CDR-grafted" antibody, in which the antibody comprises one or more CDRs from a particular species or belonging to a particular antibody class or subclass, while the remainder of the antibody chain(s) is/are identical with or homologous to a corresponding sequence in antibodies derived from another species or belonging to another antibody class or subclass. CDR grafting is described, for example, in U.S. Pat. Nos. 6,180,370, 5,693,762, 5,693,761, 5,585,089, and 5,530,101. For use in humans, the variable region or selected CDRs from a rodent or rabbit antibody often are grafted into a human antibody, replacing the naturally-occurring variable regions or CDRs of the human antibody. In some embodiments, the variable region or selected CDRs from a human antibody may be grafted into another human antibody from a different antibody class or subclass.

One useful type of chimeric antibody is a "humanized" antibody. Generally, a humanized antibody is produced from a monoclonal antibody raised initially in a non-human animal, such as a rodent or rabbit. Certain amino acid residues in this monoclonal antibody, typically from non-antigen recognizing portions of the antibody, are modified to be homologous to corresponding residues in a human antibody of corresponding isotype. Humanization can be performed, for example, using various methods by substituting at least a portion of a rodent or rabbit variable region for the corresponding regions of a human antibody (see, e.g., U.S. Pat. Nos. 5,585,089, and 5,693,762; Jones et al., 1986, Nature 321:522-525; Riechmann et al., 1988, Nature 332: 323-27; and Verhoeyen et al., 1988, Science 239:1534-1536).

In one aspect, the CDRs of the light and heavy chain variable regions of the antibodies provided herein (see, Tables 2A, 2B, 6A, and 6B) are grafted to framework regions (FRs) from antibodies from the same, or a different, phylogenetic species. For example, the CDRs of the heavy and light chain variable regions listed in Tables 2A, 2B, 6A, and 6B can be grafted to consensus human FRs or FRs from other human germline genes. To create consensus human FRs, FRs from several human heavy chain or light chain amino acid sequences may be aligned to identify a consensus amino acid sequence. Alternatively, the grafted variable regions from the one heavy or light chain may be used with a constant region that is different from the constant region of that particular heavy or light chain as disclosed herein. In other embodiments, the grafted variable regions are part of a single chain Fv antibody.

In certain embodiments, the anti-CGRP receptor antibodies, antigen-binding fragments, or antigen binding proteins of the invention are fully human antibodies or antigen-binding fragments thereof. Fully human antibodies that specifically bind to human CGRP receptor can be generated using the immunogens or fragments thereof described in WO 2010/075238, such as polypeptides consisting of any one of the sequences of SEQ ID NOs: 1 to 4. A "fully human antibody" is an antibody that comprises variable and constant regions derived from or indicative of human germ line immunoglobulin sequences. One specific means provided for implementing the production of fully human antibodies is the "humanization" of the mouse humoral immune system. Introduction of human immunoglobulin (Ig) loci into mice in which the endogenous Ig genes have been inactivated is one means of producing fully human monoclonal antibodies (mAbs) in mouse, an animal that can be immunized with any desirable antigen. Using fully human antibodies can minimize the immunogenic and allergic responses that can sometimes be caused by administering mouse or mouse-derived mAbs to humans as therapeutic agents.

Fully human antibodies can be produced by immunizing transgenic animals (usually mice) that are capable of producing a repertoire of human antibodies in the absence of endogenous immunoglobulin production. Antigens for this purpose typically have six or more contiguous amino acids, and optionally are conjugated to a carrier, such as a hapten. See, e.g., Jakobovits et al., 1993, *Proc. Natl. Acad. Sci. USA* 90:2551-2555; Jakobovits et al., 1993, *Nature* 362:255-258; and Bruggermann et al., 1993, Year in Immunol. 7:33. In one example of such a method, transgenic animals are produced by incapacitating the endogenous mouse immunoglobulin loci encoding the mouse heavy and light immunoglobulin chains therein, and inserting into the mouse genome large fragments of human genome DNA containing loci that encode human heavy and light chain proteins. Partially modified animals, which have less than the full complement of human immunoglobulin loci, are then cross-bred to obtain an animal having all of the desired immune system modifications. When administered an immunogen, these transgenic animals produce antibodies that are immunospecific for the immunogen but have human rather than murine amino acid sequences, including the variable regions. For further details of such methods, see, for example, WO96/33735 and WO94/02602. Additional methods relating to transgenic mice for making human antibodies are described in U.S. Pat. Nos. 5,545,807; 6,713,610; 6,673,986; 6,162,963; 5,939,598; 5,545,807; 6,300,129; 6,255,458; 5,877,397; 5,874,299 and 5,545,806; in PCT publications WO91/10741, WO90/04036, WO 94/02602, WO 96/30498, WO 98/24893 and in EP 546073B1 and EP 546073A1.

The transgenic mice described above, referred to as "HuMab" mice, contain a human immunoglobulin gene minilocus that encodes unrearranged human heavy (mu and gamma) and kappa light chain immunoglobulin sequences, together with targeted mutations that inactivate the endogenous mu and kappa chain loci (Lonberg et al., 1994, Nature 368:856-859). Accordingly, the mice exhibit reduced expression of mouse IgM and kappa proteins and in response to immunization, the introduced human heavy and light chain transgenes undergo class switching and somatic mutation to generate high affinity human IgG kappa monoclonal antibodies (Lonberg and Huszar, 1995, Intern. Rev. Immunol. 13: 65-93; Harding and Lonberg, 1995, Ann. N.Y Acad. Sci. 764:536-546). The preparation of HuMab mice is described in detail in Taylor et al., 1992, Nucleic Acids Research 20:6287-6295; Chen et al., 1993, International Immunology 5:647-656; Tuaillon et al., 1994, J. Immunol. 152:2912-2920; Lonberg et al., 1994, Nature 368:856-859; Lonberg, 1994, Handbook of Exp. Pharmacology 113:49-101; Taylor et al., 1994, International Immunology 6:579-591; Lonberg and Huszar, 1995, Intern. Rev. Immunol. 13:65-93; Harding and Lonberg, 1995, Ann. N.Y Acad. Sci. 764:536-546; Fishwild et al., 1996, Nature Biotechnology 14:845-851; the foregoing references are hereby incorporated by reference in their entireties. See, further U.S. Pat. Nos. 5,545,806; 5,569,825; 5,625,126; 5,633,425; 5,789,650; 5,877,397; 5,661,016; 5,814,318; 5,874,299; and 5,770,429; as well as U.S. Pat. No. 5,545,807; International Publication Nos. WO 93/1227; WO 92/22646; and WO 92/03918, the disclosures of all of which are hereby incorporated by reference in their entireties. Technologies utilized for producing human antibodies in these transgenic mice are disclosed also in WO 98/24893, and Mendez et al., 1997, Nature Genetics 15:146-156, which are hereby incorporated by reference. For example, the HCo7 and HCo12 transgenic mice strains can be used to generate fully human anti-CGRP receptor antibodies. One particular transgenic mouse line suitable for generation of fully human anti-CGRP receptor antibodies is the XenoMouse® transgenic mouse line described in U.S. Pat. Nos. 6,114,598; 6,162,963; 6,833,268; 7,049,426; 7,064,244; Green et al., 1994, Nature Genetics 7:13-21; Mendez et al., 1997, Nature Genetics 15:146-156; Green and Jakobovitis, 1998, J. Ex. Med, 188:483-495; Green, 1999, Journal of Immunological Methods 231:11-23; Kellerman and Green, 2002, Current Opinion in Biotechnology 13, 593-597, all of which are hereby incorporated by reference in their entireties.

Human-derived antibodies can also be generated using phage display techniques. Phage display is described in e.g., Dower et al., WO 91/17271, McCafferty et al., WO 92/01047, and Caton and Koprowski, 1990, Proc. Natl. Acad. Sci. USA, 87:6450-6454, each of which is incorporated herein by reference in its entirety. The antibodies produced by phage technology are usually produced as antigen-binding fragments, e.g. Fv or Fab fragments, in bacteria and thus lack effector functions. Effector functions can be introduced by one of two strategies: The fragments can be engineered either into complete antibodies for expression in mammalian cells, or into bispecific antibody fragments with a second binding site capable of triggering an effector function, if desired. Typically, the Fd fragment (VH-CH1) and light chain (VL-CL) of antibodies are separately cloned by PCR and recombined randomly in combinatorial phage display libraries, which can then be selected for binding to a particular antigen. The antibody fragments are expressed on the phage surface, and selection of Fv or Fab (and therefore the phage containing the DNA encoding the antibody fragment) by antigen binding is accomplished through several rounds of antigen binding and re-amplification, a procedure termed panning. Antibody fragments specific for the antigen are enriched and finally isolated. Phage display techniques can also be used in an approach for the humanization of rodent monoclonal antibodies, called "guided selection" (see Jespers, L. S. et al., 1994, Bio/Technology 12, 899-903). For this, the Fd fragment of the mouse monoclonal antibody can be displayed in combination with a human light chain library, and the resulting hybrid Fab library may then be selected with antigen. The mouse Fd fragment thereby provides a template to guide the selection. Subsequently, the selected human light chains are combined with a human Fd fragment library. Selection of the resulting library yields entirely human Fab.

Once cells producing anti-CGRP receptor antibodies according to the invention have been obtained using any of the above described immunization and other techniques, the specific antibody genes may be cloned by isolating and amplifying DNA or mRNA therefrom according to standard procedures as described herein. The antibodies produced therefrom may be sequenced and the CDRs identified and the DNA coding for the CDRs may be manipulated as described herein to generate other anti-CGRP receptor antibodies, antigen-binding fragments, or antigen binding proteins according to the invention.

Any of the anti-CGRP receptor antibodies or antigen-binding fragments thereof described herein can be used to construct bispecific antigen binding proteins capable of binding to and inhibiting human CGRP receptor and another target, such as human PAC1 receptor. As used herein, the term "antigen binding protein" refers to a protein that specifically binds to one or more target antigens. An antigen binding protein can include an antibody and antigen-binding fragments thereof. An antigen binding protein can also include a protein comprising one or more antigen-binding fragments incorporated into a single polypeptide chain or into multiple polypeptide chains. For instance, antigen binding proteins can include, but are not limited to, a diabody (see, e.g., EP 404,097; WO 93/11161; and Hollinger et al., Proc. Natl. Acad. Sci. USA, Vol. 90:6444-6448, 1993); an intrabody; a domain antibody (single VL or VH domain or two or more VH domains joined by a peptide linker; see Ward et al., Nature, Vol. 341:544-546, 1989); a maxibody (2 scFvs fused to Fc region, see Fredericks et al., Protein Engineering, Design & Selection, Vol. 17:95-106, 2004 and Powers et al., Journal of Immunological Methods, Vol. 251:123-135, 2001); a triabody; a tetrabody; a minibody (scFv fused to CH3 domain; see Olafsen et al., Protein Eng Des Sel., Vol. 17:315-23, 2004); a peptibody (one or more peptides attached to an Fc region or an antibody, see WO 00/24782); a linear antibody (a pair of tandem Fd segments (VH-CH1-VH-CH1) which, together with complementary light chain polypeptides, form a pair of antigen binding regions, see Zapata et al., Protein Eng., Vol. 8:1057-1062, 1995); a small modular immunopharmaceutical (see U.S. Patent Publication No. 20030133939); and immunoglobulin fusion proteins (e.g. IgG-scFv, IgG-Fab, 2scFv-IgG, 4scFv-IgG, VH-IgG, IgG-VH, and Fab-scFv-Fc).

In certain embodiments, the antigen binding proteins of the invention are "bispecific" meaning that they are capable of specifically binding to two different antigens, human CGRP receptor and another target antigen, such as human PAC1 receptor. In some embodiments of the invention, the antigen binding proteins are multivalent. The valency of the binding protein denotes the number of individual antigen binding domains within the binding protein. For example, the terms "monovalent," "bivalent," and "tetravalent" with reference to the antigen binding proteins of the invention refer to binding proteins with one, two, and four antigen binding domains, respectively. Thus, a multivalent antigen binding protein comprises two or more antigen binding domains. In certain embodiments, the bispecific antigen binding proteins of the invention are bivalent. Thus, such bispecific, bivalent antigen binding proteins contain two antigen binding domains: one antigen-binding domain binding to human CGRP receptor and one antigen-binding domain binding to another target antigen, such as the human PAC1 receptor.

As used herein, the term "antigen binding domain," which is used interchangeably with "binding domain," refers to the region of the antigen binding protein that contains the amino acid residues that interact with the antigen and confer on the antigen binding protein its specificity and affinity for the antigen. In certain embodiments, the binding domain of the antigen binding proteins of the invention may be derived from an antibody or antigen-binding fragment thereof. For instance, the binding domains of the bispecific antigen binding proteins of the invention may comprise one or more complementarity determining regions (CDR) from the light and heavy chain variable regions of antibodies that specifically bind to human CGRP receptor or human PAC1 receptor. In some embodiments, the anti-CGRP receptor binding domain of the bispecific antigen binding proteins of the invention comprises all six CDRs of the heavy and light chain variable regions of an anti-CGRP receptor antibody described herein and the anti-PAC1 receptor binding domain of the bispecific antigen binding proteins of the invention comprises all six CDRs of the heavy and light chain variable regions of an anti-PAC1 receptor antibody described herein. In some embodiments, the binding domains (the anti-CGRP receptor binding domain, the anti-PAC1 receptor binding domain or both) of the bispecific antigen binding proteins of the invention comprise a Fab, a Fab', a F(ab')2, a Fv, a single-chain variable fragment (scFv), or a nanobody. In one embodiment, both binding domains are Fab fragments. In another embodiment, one binding domain is a Fab fragment and the other binding domain is a scFv. In yet another embodiment, both binding domains are scFvs.

Papain digestion of antibodies produces two identical antigen-binding fragments, called "Fab" fragments, each with a single antigen-binding site, and a residual "Fc" fragment which contains all but the first domain of the immunoglobulin heavy chain constant region. The Fab fragment contains the variable domains from the light and heavy chains, as well as the constant domain of the light chain and the first constant domain (CH1) of the heavy chain. Thus, a "Fab fragment" is comprised of one immunoglobulin light chain (light chain variable region (VL) and constant region (CL)) and the CH1 domain and variable region (VH) of one immunoglobulin heavy chain. The heavy chain of a Fab molecule cannot form a disulfide bond with another heavy chain molecule. The "Fd fragment" comprises the VH and CH1 domains from an immunoglobulin heavy chain. The Fd fragment represents the heavy chain component of the Fab fragment.

The "Fc fragment" or "Fc region" of an immunoglobulin generally comprises two constant domains, a CH2 domain and a CH3 domain, and optionally comprises a CH4 domain. In certain embodiments, the antigen binding proteins of the invention comprise an Fc region from an immunoglobulin. The Fc region may be an Fc region from an IgG1, IgG2, IgG3, or IgG4 immunoglobulin. In some embodiments, the Fc region comprises CH2 and CH3 domains from a human IgG1 or human IgG2 immunoglobulin. The Fc region may retain effector function, such as C1q binding, complement dependent cytotoxicity (CDC), Fc receptor binding, antibody-dependent cell-mediated cytotoxicity (ADCC), and phagocytosis. In other embodiments, the Fc region may be modified to reduce or eliminate effector function as described in further detail herein.

A "Fab' fragment" is a Fab fragment having at the C-terminus of the CH1 domain one or more cysteine residues from the antibody hinge region.

A "$F(ab')_2$ fragment" is a bivalent fragment including two Fab' fragments linked by a disulfide bridge between the heavy chains at the hinge region.

The "Fv" fragment is the minimum fragment that contains a complete antigen recognition and binding site from an antibody. This fragment consists of a dimer of one immunoglobulin heavy chain variable region (VH) and one immunoglobulin light chain variable region (VL) in tight, non-covalent association. It is in this configuration that the three CDRs of each variable region interact to define an antigen binding site on the surface of the VH-VL dimer. A single light chain or heavy chain variable region (or half of an Fv fragment comprising only three CDRs specific for an antigen) has the ability to recognize and bind antigen, although at a lower affinity than the entire binding site comprising both VH and VL.

A "single-chain variable fragment" or "scFv fragment" comprises the VH and VL regions of an antibody, wherein these regions are present in a single polypeptide chain, and optionally comprising a peptide linker between the VH and VL regions that enables the Fv to form the desired structure for antigen binding (see e.g., Bird et al., Science, Vol. 242:423-426, 1988; and Huston et al., Proc. Natl. Acad. Sci. USA, Vol. 85:5879-5883, 1988).

A "nanobody" is the heavy chain variable region of a heavy-chain antibody. Such variable domains are the smallest fully functional antigen-binding fragment of such heavy-chain antibodies with a molecular mass of only 15 kDa. See Cortez-Retamozo et al., *Cancer Research* 64:2853-57, 2004. Functional heavy-chain antibodies devoid of light chains are naturally occurring in certain species of animals, such as nurse sharks, wobbegong sharks and Camelidae, such as camels, dromedaries, alpacas and llamas. The antigen-binding site is reduced to a single domain, the VHH domain, in these animals. These antibodies form antigen-binding regions using only heavy chain variable region, i.e., these functional antibodies are homodimers of heavy chains only having the structure H2L2 (referred to as "heavy-chain antibodies" or "HCAbs"). Camelized VHH reportedly recombines with IgG2 and IgG3 constant regions that contain hinge, CH2, and CH3 domains and lack a CH1 domain. Camelized VHH domains have been found to bind to antigen with high affinity (Desmyter et al., J. Biol. Chem., Vol. 276:26285-90, 2001) and possess high stability in solution (Ewert et al., Biochemistry, Vol. 41:3628-36, 2002). Methods for generating antibodies having camelized heavy chains are described in, for example, U.S. Patent Publication Nos. 2005/0136049 and 2005/0037421. Alternative scaffolds can be made from human variable-like domains that more closely match the shark V-NAR scaffold and may provide a framework for a long penetrating loop structure.

In certain embodiments, the binding domains of the bispecific antigen binding proteins of the invention comprise an immunoglobulin heavy chain variable region (VH) and an immunoglobulin light chain variable region (VL) of an antibody or antibody fragment which specifically binds to the desired antigen. For instance, the anti-CGRP receptor binding domain of the bispecific antigen binding proteins of the invention comprises a VH region and VL region from an anti-CGRP receptor antibody, such as any of the anti-CGRP receptor antibodies described herein, and the anti-PAC1 receptor binding domain comprises a VH region and VL region from an anti-PAC1 receptor antibody, such as any of the anti-PAC1 receptor antibodies described herein. The binding domains that specifically bind to human CGRP receptor or human PAC1 receptor can be derived from known antibodies to these antigens or from new antibodies or antibody fragments obtained by de novo immunization methods using the antigen proteins or fragments thereof, by phage display, or other methods described herein or known in the art. The antibodies from which the binding domains for the bispecific antigen binding proteins are derived can be monoclonal antibodies, recombinant antibodies, human antibodies, or humanized antibodies. In certain embodiments, the antibodies from which the binding domains are derived are monoclonal antibodies. In these and other embodiments, the antibodies are human antibodies or humanized antibodies and can be of the IgG1-, IgG2-, IgG3-, or IgG4-type.

The bispecific antigen binding proteins of the invention comprise a binding domain that specifically binds to the human CGRP receptor. In certain embodiments, the anti-CGRP receptor binding domain of the bispecific antigen binding proteins of the invention comprises the VH region and/or the VL region or CDR regions from an anti-CGRP receptor antibody or antigen-binding fragment thereof. Preferably, the anti-CGRP receptor antibody or antigen-binding fragment thereof specifically binds to human CGRP receptor and prevents or reduces binding of the receptor to CGRP. In some embodiments, the anti-CGRP receptor antibody or antigen-binding fragment thereof from which the anti-CGRP receptor binding domain is derived specifically binds to residues or sequences of residues, or regions in both human CRLR and human RAMP1 polypeptides. In one embodiment, the anti-CGRP receptor antibody or antigen-binding fragment thereof specifically binds to an epitope formed from amino acids in both human CRLR and human RAMP1 polypeptides (e.g., SEQ ID NOs: 1 and 2, respectively). In another embodiment, the anti-CGRP receptor antibody or antigen-binding fragment thereof specifically binds to an epitope formed from amino acids in the extracellular domains of both human CRLR and human RAMP1 polypeptides (e.g., SEQ ID NOs: 3 and 4, respectively). In some embodiments, the epitope formed from amino acids in both human CRLR and human RAMP1 polypeptides comprises one or more cleavage sites for AspN protease, which cleaves peptides after aspartic acid residues and some glutamic acid residues at the amino end. In certain embodiments, the anti-CGRP receptor antibody or antigen-binding fragment thereof from which the anti-CGRP receptor binding domain is derived specifically binds to the extracellular domain of human CRLR polypeptide comprising the amino acid sequence of SEQ ID NO: 3 and/or the extracellular domain of human RAMP1 polypeptide comprising the amino acid sequence of SEQ ID NO: 4.

The variable regions or CDR regions of any of the anti-CGRP receptor antibodies or antigen-binding fragments described herein can be used to construct the anti-CGRP receptor binding domain of the bispecific antigen binding proteins of the invention. As described in the Examples, the anti-CGRP receptor antibodies of the invention have enhanced inhibitory potency compared to previously described anti-CGRP receptor antibodies, such as the antibodies described in WO 2010/075238. Light chain and heavy chain variable regions and associated CDRs of exemplary human anti-CGRP receptor antibodies from which the anti-CGRP receptor binding domain of the bispecific antigen binding proteins of the invention can be derived or constructed are set forth in Tables 2A and 2B, respectively.

The anti-CGRP receptor binding domain of the bispecific antigen binding proteins may comprise one or more of the CDRs presented in Table 2A (light chain CDRs; i.e. CDRLs) and Table 2B (heavy chain CDRs, i.e. CDRHs). For instance, in certain embodiments, the anti-CGRP receptor binding domain comprises one or more light chain CDRs selected from (i) a CDRL1 selected from SEQ ID NOs: 5 to 12, (ii) a CDRL2 selected from SEQ ID NOs: 13 to 16, and (iii) a CDRL3 selected from SEQ ID NOs: 17 to 22. In these and other embodiments, the anti-CGRP receptor binding domain comprises one or more heavy chain CDRs selected from (i) a CDRH1 selected from SEQ ID NOs: 35 to 38, (ii) a CDRH2 selected from SEQ ID NOs: 39 to 42, and (iii) a CDRH3 selected from SEQ ID NOs: 44 to 46.

In particular embodiments, the anti-CGRP receptor binding domain of the bispecific antigen binding proteins of the invention comprises a light chain variable region comprising a CDRL1, a CDRL2, and a CDRL3, wherein: (a) CDRL1, CDRL2, and CDRL3 have the sequence of SEQ ID NOs: 6, 13 and 17, respectively; (b) CDRL1, CDRL2, and CDRL3 have the sequence of SEQ ID NOs: 7, 13 and 17, respectively; (c) CDRL1, CDRL2, and CDRL3 have the sequence of SEQ ID NOs: 5, 13 and 17, respectively; (d) CDRL1, CDRL2, and CDRL3 have the sequence of SEQ ID NOs: 8, 14 and 18, respectively; (e) CDRL1, CDRL2, and CDRL3 have the sequence of SEQ ID NOs: 9, 13 and 17, respectively; (f) CDRL1, CDRL2, and CDRL3 have the sequence of SEQ ID NOs: 10, 13 and 17, respectively; (g) CDRL1, CDRL2, and CDRL3 have the sequence of SEQ ID NOs: 11, 15 and 19, respectively; (h) CDRL1, CDRL2, and CDRL3 have the sequence of SEQ ID NOs: 11, 16 and 20, respectively; (i) CDRL1, CDRL2, and CDRL3 have the sequence of SEQ ID NOs: 12, 13 and 17, respectively; (j) CDRL1, CDRL2, and CDRL3 have the sequence of SEQ ID NOs: 5, 13 and 21, respectively; or (k) CDRL1, CDRL2, and CDRL3 have the sequence of SEQ ID NOs: 5, 13 and 22, respectively.

In other particular embodiments, the anti-CGRP receptor binding domain of the bispecific antigen binding proteins of the invention comprises a heavy chain variable region comprising a CDRH1, a CDRH2, and a CDRH3, wherein: (a) CDRH1, CDRH2, and CDRH3 have the sequence of SEQ ID NOs: 35, 39 and 44, respectively; (b) CDRH1, CDRH2, and CDRH3 have the sequence of SEQ ID NOs: 35, 39 and 45, respectively; (c) CDRH1, CDRH2, and CDRH3 have the sequence of SEQ ID NOs: 36, 39 and 44, respectively; (d) CDRH1, CDRH2, and CDRH3 have the sequence of SEQ ID NOs: 35, 40 and 44, respectively; (e) CDRH1, CDRH2, and CDRH3 have the sequence of SEQ ID NOs: 37, 41 and 44, respectively; or (f) CDRH1, CDRH2, and CDRH3 have the sequence of SEQ ID NOs: 38, 42 and 46, respectively.

In certain embodiments, the anti-CGRP receptor binding domain of the bispecific antigen binding proteins of the invention comprises a light chain variable region comprising a CDRL1, a CDRL2, and a CDRL3 and a heavy chain variable region comprising a CDRH1, a CDRH2, and a CDRH3, wherein:

(a) CDRL1, CDRL2, and CDRL3 have the sequence of SEQ ID NOs: 6, 13 and 17, respectively, and CDRH1, CDRH2, and CDRH3 have the sequence of SEQ ID NOs: 35, 39 and 44, respectively;
(b) CDRL1, CDRL2, and CDRL3 have the sequence of SEQ ID NOs: 7, 13 and 17, respectively, and CDRH1, CDRH2, and CDRH3 have the sequence of SEQ ID NOs: 35, 39 and 44, respectively;
(c) CDRL1, CDRL2, and CDRL3 have the sequence of SEQ ID NOs: 5, 13 and 17, respectively, and CDRH1, CDRH2, and CDRH3 have the sequence of SEQ ID NOs: 35, 39 and 45, respectively;
(d) CDRL1, CDRL2, and CDRL3 have the sequence of SEQ ID NOs: 8, 14 and 18, respectively, and CDRH1, CDRH2, and CDRH3 have the sequence of SEQ ID NOs: 35, 39 and 44, respectively;
(e) CDRL1, CDRL2, and CDRL3 have the sequence of SEQ ID NOs: 9, 13 and 17, respectively, and CDRH1, CDRH2, and CDRH3 have the sequence of SEQ ID NOs: 35, 39 and 44, respectively;
(f) CDRL1, CDRL2, and CDRL3 have the sequence of SEQ ID NOs: 5, 13 and 17, respectively, and CDRH1, CDRH2, and CDRH3 have the sequence of SEQ ID NOs: 36, 39 and 44, respectively;
(g) CDRL1, CDRL2, and CDRL3 have the sequence of SEQ ID NOs: 10, 13 and 17, respectively, and CDRH1, CDRH2, and CDRH3 have the sequence of SEQ ID NOs: 35, 39 and 44, respectively;
(h) CDRL1, CDRL2, and CDRL3 have the sequence of SEQ ID NOs: 5, 13 and 17, respectively, and CDRH1, CDRH2, and CDRH3 have the sequence of SEQ ID NOs: 35, 40 and 44, respectively;
(i) CDRL1, CDRL2, and CDRL3 have the sequence of SEQ ID NOs: 5, 13 and 17, respectively, and CDRH1, CDRH2, and CDRH3 have the sequence of SEQ ID NOs: 37, 41 and 44, respectively;
(j) CDRL1, CDRL2, and CDRL3 have the sequence of SEQ ID NOs: 11, 15 and 19, respectively, and CDRH1, CDRH2, and CDRH3 have the sequence of SEQ ID NOs: 38, 42 and 46, respectively;
(k) CDRL1, CDRL2, and CDRL3 have the sequence of SEQ ID NOs: 11, 16 and 20, respectively, and CDRH1, CDRH2, and CDRH3 have the sequence of SEQ ID NOs: 35, 39 and 44, respectively;
(l) CDRL1, CDRL2, and CDRL3 have the sequence of SEQ ID NOs: 12, 13 and 17, respectively, and CDRH1, CDRH2, and CDRH3 have the sequence of SEQ ID NOs: 35, 39 and 44, respectively;
(m) CDRL1, CDRL2, and CDRL3 have the sequence of SEQ ID NOs: 5, 13 and 21, respectively, and CDRH1, CDRH2, and CDRH3 have the sequence of SEQ ID NOs: 35, 39 and 44, respectively; or
(n) CDRL1, CDRL2, and CDRL3 have the sequence of SEQ ID NOs: 5, 13 and 22, respectively, and CDRH1, CDRH2, and CDRH3 have the sequence of SEQ ID NOs: 35, 39 and 44, respectively.

In some embodiments, the anti-CGRP receptor binding domain of the bispecific antigen binding proteins of the invention comprises a light chain variable region comprising a CDRL1, a CDRL2, and a CDRL3 and a heavy chain variable region comprising a CDRH1, a CDRH2, and a CDRH3, wherein:

(a) CDRL1, CDRL2, and CDRL3 have the sequence of SEQ ID NOs: 6, 13 and 17, respectively, and CDRH1, CDRH2, and CDRH3 have the sequence of SEQ ID NOs: 35, 39 and 44, respectively;
(b) CDRL1, CDRL2, and CDRL3 have the sequence of SEQ ID NOs: 7, 13 and 17, respectively, and CDRH1, CDRH2, and CDRH3 have the sequence of SEQ ID NOs: 35, 39 and 44, respectively;
(c) CDRL1, CDRL2, and CDRL3 have the sequence of SEQ ID NOs: 5, 13 and 17, respectively, and CDRH1, CDRH2, and CDRH3 have the sequence of SEQ ID NOs: 35, 39 and 45, respectively;
(d) CDRL1, CDRL2, and CDRL3 have the sequence of SEQ ID NOs: 8, 14 and 18, respectively, and CDRH1, CDRH2, and CDRH3 have the sequence of SEQ ID NOs: 35, 39 and 44, respectively; or
(e) CDRL1, CDRL2, and CDRL3 have the sequence of SEQ ID NOs: 9, 13 and 17, respectively, and CDRH1, CDRH2, and CDRH3 have the sequence of SEQ ID NOs: 35, 39 and 44, respectively.

The anti-CGRP receptor binding domain of the bispecific antigen binding proteins of the invention may comprise a light chain variable region selected from the group consisting of LV-01, LV-02, LV-03, LV-04, LV-05, LV-06, LV-07, LV-08, LV-09, LV-10, LV-11, and LV-12, as shown in Table 2A, and/or a heavy chain variable region selected from the group consisting of HV-01, HV-02, HV-03, HV-04, HV-05, HV-06, and HV-07, as shown in Table 2B, and antigen-binding fragments, derivatives, muteins and variants of these light chain and heavy chain variable regions. Each of the light chain variable regions listed in Table 2A may be combined with any of the heavy chain variable regions shown in Table 2B to form an anti-CGRP receptor binding domain suitable for incorporation into the bispecific antigen binding proteins of the invention. For instance, in certain embodiments, the anti-CGRP receptor binding domain comprises a light chain variable region and a heavy chain variable region, wherein: (a) the light chain variable region comprises the sequence of SEQ ID NO: 25 and the heavy chain variable region comprises the sequence of SEQ ID NO: 48; (b) the light chain variable region comprises the sequence of SEQ ID NO: 26 and the heavy chain variable region comprises the sequence of SEQ ID NO: 48; (c) the light chain variable region comprises the sequence of SEQ ID NO: 23 and the heavy chain variable region comprises the sequence of SEQ ID NO: 49; (d) the light chain variable region comprises the sequence of SEQ ID NO: 24 and the heavy chain variable region comprises the sequence of SEQ ID NO: 49; (e) the light chain variable region comprises the sequence of SEQ ID NO: 27 and the heavy chain variable region comprises the sequence of SEQ ID NO: 48; (f) the light chain variable region comprises the sequence of SEQ ID NO: 28 and the heavy chain variable region comprises the sequence of SEQ ID NO: 48; (g) the light chain variable region comprises the sequence of SEQ ID NO: 24 and the heavy chain variable region comprises the sequence of SEQ ID NO: 50; (h) the light chain variable region comprises the sequence of SEQ ID NO: 29 and the heavy chain variable region comprises the sequence of SEQ ID NO: 48; (i) the light chain variable region comprises the sequence of SEQ ID NO: 24 and the heavy chain variable region comprises the sequence of SEQ ID NO: 51; (j) the light chain variable region comprises the sequence of SEQ ID NO: 24 and the heavy chain variable region comprises the sequence of SEQ ID NO: 52; (k) the light chain variable region comprises the sequence of SEQ ID NO: 30 and the heavy chain variable region comprises the sequence of SEQ ID NO: 53; (1) the light chain variable region comprises the sequence of SEQ ID NO: 31 and the heavy chain variable region comprises the sequence of SEQ ID NO: 48; (m) the light chain variable region comprises the sequence of SEQ ID NO: 32 and the heavy chain variable region comprises the sequence of SEQ ID NO: 48; (n) the light chain variable region comprises the sequence of SEQ ID NO: 33 and the heavy chain variable region comprises the sequence of SEQ ID NO: 48; or (o) the light chain variable region comprises the sequence of SEQ ID NO: 34 and the heavy chain variable region comprises the sequence of SEQ ID NO: 48.

In some embodiments, the anti-CGRP receptor binding domain comprises a light chain variable region comprising a sequence of contiguous amino acids that differs from the sequence of a light chain variable region in Table 2A, i.e. a VL selected from LV-01, LV-02, LV-03, LV-04, LV-05, LV-06, LV-07, LV-08, LV-09, LV-10, LV-11, and LV-12 at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The light chain variable region in some anti-CGRP receptor binding domains comprises a sequence of amino acids that has at least 70%, at least 75%, at least 80%, at least 85%, at least 90%, at least 95%, at least 97% or at least 99% sequence identity to the amino acid sequences of SEQ ID NOs: 23-34 (i.e. the light chain variable regions in Table 2A). In one embodiment, the anti-CGRP receptor binding domain comprises a light chain variable region that comprises a sequence that is at least 90% identical to an amino acid sequence selected from SEQ ID NOs: 23-34. In another embodiment, the anti-CGRP receptor binding domain comprises a light chain variable region that comprises a sequence that is at least 95% identical to an amino acid sequence selected from SEQ ID NOs: 23-34.

In these and other embodiments, the anti-CGRP receptor binding domain comprises a heavy chain variable region comprising a sequence of contiguous amino acids that differs from the sequence of a heavy chain variable region in Table 2B, i.e., a VH selected from HV-01, HV-02, HV-03, HV-04, HV-05, HV-06, and HV-07 at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The heavy chain variable region in some anti-CGRP receptor binding domains comprises a sequence of amino acids that has at least 70%, at least 75%, at least 80%, at least 85%, at least 90%, at least 95%, at least 97% or at least 99% sequence identity to the amino acid sequences of SEQ ID NOs: 47-53 (i.e. the heavy chain variable regions in Table 2B). In one embodiment, the anti-CGRP receptor binding domain comprises a heavy chain variable region that comprises a sequence that is at least 90% identical to an amino acid sequence selected from SEQ ID NOs: 48-53. In another embodiment, the anti-CGRP receptor binding domain comprises a heavy chain variable region that comprises a sequence that is at least 95% identical to an amino acid sequence selected from SEQ ID NOs: 48-53.

In certain embodiments, the bispecific antigen binding proteins of the invention comprise a binding domain that specifically binds to the human pituitary adenylate cyclase-activating polypeptide type I (PAC1) receptor. In such embodiments, the bispecific antigen binding proteins comprise a first binding domain that specifically binds to human CGRP receptor and a second binding domain that specifically binds to human PAC1 receptor. As both CGRP receptor and PAC1 receptor signaling are implicated in the control of cerebral vascular tone, the bispecific binding proteins of the invention provide a means to simultaneously modulate both signaling cascades to ameliorate conditions associated with dysregulation of the cranial vasculature, such as cluster headache and migraine.

Human PAC1 is a 468 amino acid protein (NCBI Reference Sequence NP 001109.2) encoded by the ADCYAP1R1 gene on chromosome 7. The human PAC1 receptor is a G protein-coupled receptor that is positively coupled to adenylate cyclase. Activation of the human PAC1 receptor by its endogenous ligands (e.g. PACAP38 or PACAP27) results in an increase in intracellular cyclic AMP (cAMP). The amino acid sequence for human PAC1 is provided below as SEQ ID NO: 129.

```
  1  MAGVVHVSLA ALLLLPMAPA MHSDCIFKKE QAMCLEKIQR ANELMGFNDS SPGCPGMWDN

 61  ITCWKPAHVG EMVLVSCPEL FRIFNPDQVW ETETIGESDF GDSNSLDLSD MGVVSRNCTE

121  DGWSEPFPHY FDACGFDEYE SETGDQDYYY LSVKALYTVG YSTSLVTLTT AMVILCRFRK

181  LHCTRNFIHM NLFVSFMLRA ISVFIKDWIL YAEQDSNHCF ISTVECKAVM VFFHYCVVSN

241  YFWLFIEGLY LFTLLVETFF PERRYFYWYT IIGWGTPTVC VTVWATLRLY FDDTGCWDMN
```

-continued

```
301    DSTALWWVIK GPVVGSIMVN FVLFIGIIVI LVQKLQSPDM GGNESSIYLR LARSTLLLIP

361    LFGIHYTVFA FSPENVSKRE RLVFELGLGS FQGFVVAVLY CFLNGEVQAE IKRKWRSWKV

421    NRYFAVDFKH RHPSLASSGV NGGTQLSILS KSSSQIRMSG LPADNLAT
```

Amino acids 1 to 23 of the human PAC1 protein (SEQ ID NO: 129) constitute a signal peptide, which is generally removed from the mature protein. The mature human PAC1 protein has the basic structure of a G protein-coupled receptor consisting of a seven-transmembrane domain, an extracellular domain composed of an N-terminal region and three extracellular loops, three intracellular loops, and a C-terminal cytoplasmic domain. The N-terminal extracellular domain is approximately at amino acids 24-153 of SEQ ID NO: 129, and the first of seven transmembrane domains begins at amino acid 154 of SEQ ID NO: 129. The C-terminal cytoplasmic domain is located approximately at amino acids 397-468 of SEQ ID NO: 129. See Blechman and Levkowitz, Front. Endocrinol., Vol. 4 (55): 1-19, 2013 for location of domains within the amino acid sequence. The terms "human PAC1," "human PAC1 receptor," "hPAC1," and "hPAC1 receptor" are used interchangeably and can refer to a polypeptide of SEQ ID NO: 129, a polypeptide of SEQ ID NO: 129 minus the signal peptide (amino acids 1 to 23), allelic variants of human PAC1 receptor, or splice variants of human PAC1 receptor.

In certain embodiments, the anti-PAC1 binding domain of the bispecific antigen binding proteins of the invention comprises the VH region and/or the VL region or CDR regions from an anti-PAC1 receptor antibody or antigen-binding fragment thereof. Preferably, the anti-PAC1 receptor antibody or antigen-binding fragment specifically binds to human PAC1 receptor and prevents or reduces binding of the receptor to its ligand, such as PACAP-38 and/or PACAP-27. In some embodiments, the anti-PAC1 receptor antibody or antigen-binding fragment specifically binds to an extracellular region of the human PAC1 receptor. In one embodiment, the anti-PAC1 receptor antibody or antigen-binding fragment specifically binds to the amino-terminal extracellular domain of the PAC1 receptor (i.e. amino acids 24-153 of SEQ ID NO: 129). In certain embodiments, the anti-PAC1 antibody or antigen-binding fragment from which the anti-PAC1 binding domain of the bispecific antigen binding proteins of the invention is derived binds to human PAC1 receptor with a $K_D$ of $\leq 1\times10^{-9}$ M, $\leq 1\times10^{-10}$ M, $\leq 1\times10^{-11}$ M, or lower as measured by a surface plasmon resonance assay (e.g., BIAcore®-based assay).

In some embodiments, the anti-PAC1 antibody or antigen-binding fragment from which the anti-PAC1 binding domain of the bispecific antigen binding proteins of the invention is derived selectively inhibits the human PAC1 receptor relative to the human VPAC1 and human VPAC2 receptors. As described above, selective inhibition of any particular antibody, antigen-binding fragment, or antigen binding protein can be determined by comparing the IC50 of the antibody, antigen-binding fragment, or antigen binding protein in an inhibition assay for the specific receptor (e.g. human PAC1 receptor) to the IC50 of the antibody, antigen-binding fragment, or antigen binding protein in an inhibition assay for another "reference" receptor (e.g., human VPAC1 or human VPAC2 receptor). The IC50 value for any anti-PAC1 antibody, antigen-binding fragment, or antigen binding protein can be calculated as described herein, for example, by determining the concentration of the antibody, antigen-binding fragment, or antigen binding protein needed to inhibit half of the maximum biological response of the PACAP ligand (PACAP-27 or PACAP-38) in activating the human PAC1 receptor in any functional assay, such as the cAMP assay described in the Examples. An anti-PAC1 receptor antigen binding protein, antibody or binding fragment that inhibits ligand-induced (e.g. PACAP-induced) activation of the PAC1 receptor is understood to be a neutralizing or antagonist antigen binding protein, antibody or binding fragment of the PAC1 receptor.

The variable regions or CDR regions of any anti-PAC1 receptor antibody or antigen-binding fragment thereof, such as the antibodies and binding fragments described herein, can be used to construct the anti-PAC1 binding domain of the bispecific antigen binding proteins of the invention. Light chain and heavy chain variable regions and associated CDRs of exemplary human anti-PAC1 receptor antibodies from which the anti-PAC1 binding domain of the bispecific antigen binding proteins of the invention can be derived or constructed are set forth below in Tables 6A and 6B, respectively.

TABLE 6A

Exemplary Anti-Human PAC1 Receptor Antibody Light Chain Variable Region Amino Acid Sequences

| Antibody ID. | VL Group | VL Amino Acid Sequence | CDRL1 | CDRL2 | CDRL3 |
|---|---|---|---|---|---|
| 29G4v22 | LV-101 | DIQLTQSPSFLSASVGDRVTITCRA SQSIGRSLHWYQQKPGKAPKLLIK YASQSLSGVPSRFSGSGSGTEFTL TISSLQPEDFATYYCHQSSRLPFTF GPGTKVDIKR (SEQ ID NO: 146) | RASQSIGRSLH (SEQ ID NO: 130) | YASQSLS (SEQ ID NO: 141) | HQSSRLPFT (SEQ ID NO: 142) |
| 101A, 101B, 101C, 101D, 101E, 101F, 101G, 102A, 102B, 102C, 102D, 123A, 123B, 124A, 124B, 125A, | LV-102 | EIVLTQSPATLSLSPGERATLSCRA SKSVGRSLHWYQQKPGQAPRLLI KYASQSLSGIPARFSGSGSGTDFT LTISSLEPEDFAVYYCHQSSRLPFT FGPGTKVDIK (SEQ ID NO: 147) | RASKSVGRSLH (SEQ ID NO: 131) | YASQSLS (SEQ ID NO: 141) | HQSSRLPFT (SEQ ID NO: 142) |

TABLE 6A-continued

Exemplary Anti-Human PAC1 Receptor Antibody Light Chain Variable Region Amino Acid Sequences

| Antibody ID. | VL Group | VL Amino Acid Sequence | CDRL1 | CDRL2 | CDRL3 |
|---|---|---|---|---|---|
| 125B, 126A, 126B, 127A, 127B, 131A, 131B, 132A, 132B | | | | | |
| 103A, 103B, 104A, 104B, 105A, 105B, 106A, 106B, 107A, 107B, 109A, 109B, 110A, 110B, 111A, 111B, 116A, 116B | LV-103 | EIVLTQSPATLSLSPGERATLSCRASKSVGWSLHWYQQKPGQAPRLLIKYASQSLSGIPARFSGSGSGTDFTLTISSLEPEDFAVYYCHQSSRLPFTFGPGTKVDIKR (SEQ ID NO: 148) | RASKSVGWSLH (SEQ ID NO: 132) | YASQSLS (SEQ ID NO: 141) | HQSSRLPFT (SEQ ID NO: 142) |
| 108A, 108B | LV-104 | EIVLTQSPATLSLSPGERATLSCRASKSVGYSLHWYQQKPGQAPRLLIKYASQSLSGIPARFSGSGSGTDFTLTISSLEPEDFAVYYCHQSSRLPFTFGPGTKVDIKR (SEQ ID NO: 149) | RASKSVGYSLH (SEQ ID NO: 133) | YASQSLS (SEQ ID NO: 141) | HQSSRLPFT (SEQ ID NO: 142) |
| 112A, 112B | LV-105 | EIVLTQSPATLSLSPGERATLSCRASKAVGWSLHWYQQKPGQAPRLLIKYASQSLSGIPARFSGSGSGTDFTLTISSLEPEDFAVYYCHQSSRLPFTFGPGTKVDIKR (SEQ ID NO: 150) | RASKAVGWSLH (SEQ ID NO: 134) | YASQSLS (SEQ ID NO: 141) | HQSSRLPFT (SEQ ID NO: 142) |
| 113A, 113B, 114A, 114B, 117A, 117B, 118A, 118B, 119A, 119B | LV-106 | EIVLTQSPATLSLSPGERATLSCRASKSVGQSLHWYQQKPGQAPRLLIKYASQSLSGIPARFSGSGSGTDFTLTISSLEPEDFAVYYCHQSSRLPFTFGPGTKVDIKR (SEQ ID NO: 151) | RASKSVGQSLH (SEQ ID NO: 135) | YASQSLS (SEQ ID NO: 141) | HQSSRLPFT (SEQ ID NO: 142) |
| 115A, 115B | LV-107 | EIVLTQSPATLSLSPGERATLSCRASRSVGLALHWYQQKPGQAPRLLIKYASQSLSGIPARFSGSGSGTDFTLTISSLEPEDFAVYYCHQSSFLPFTFGPGTKVDIKR (SEQ ID NO: 152) | RASRSVGLALH (SEQ ID NO: 136) | YASQSLS (SEQ ID NO: 141) | HQSSFLPFT (SEQ ID NO: 143) |
| 120A, 120B | LV-108 | EIVLTQSPATLSLSPGERATLSCRASKAVGFSLHWYQQKPGQAPRLLIKYASQSLSGIPARFSGSGSGTDFTLTISSLEPEDFAVYYCHQSSFLPFTFGPGTKVDIKR (SEQ ID NO: 153) | RASKAVGFSLH (SEQ ID NO: 137) | YASQSLS (SEQ ID NO: 141) | HQSSFLPFT (SEQ ID NO: 143) |
| 121A, 121B | LV-109 | EIVLTQSPATLSLSPGERATLSCRASRAVSNLHWYQQKPGQAPRLLIKYASQSLSGIPARFSGSGSGTDFTLTISSLEPEDFAVYYCHQSSYLPFTFGPGTKVDIKR (SEQ ID NO: 154) | RASRAVSNLH (SEQ ID NO: 138) | YASQSLS (SEQ ID NO: 141) | HQSSYLPFT (SEQ ID NO: 144) |
| 122A, 122B | LV-110 | EIVLTQSPATLSLSPGERATLSCRASKAVWHNLHWYQQKPGQAPRLLIKYASQSLSGIPARFSGSGSGTDFTLTISSLEPEDFAVYYCHQSSMLPFTFGPGTKVDIKR (SEQ ID NO: 155) | RASKAVWHNLH (SEQ ID NO: 139) | YASQSLS (SEQ ID NO: 141) | HQSSMLPFT (SEQ ID NO: 145) |
| 128A, 128B, 129A, 129B, 130A, 130B | LV-111 | EIVLTQSPATLSLSPGERATLSCRASQSVGRSLHWYQQKPGQAPRLLIKYASQSLSGIPARFSGSGSGTDFTLTISSLEPEDFAVYYCHQSSRLPFTFGPGTKVDIK (SEQ ID NO: 156) | RASQSVGRSLH (SEQ ID NO: 140) | YASQSLS (SEQ ID NO: 141) | HQSSRLPFT (SEQ ID NO: 142) |

TABLE 6B

Exemplary Anti-Human PAC1 Receptor Antibody Heavy Chain Variable Region Amino Acid Sequences

| Antibody ID. | VH Group | VH Amino Acid Sequence | CDRH1 | CDRH2 | CDRH3 |
|---|---|---|---|---|---|
| 29G4v22 | HV-101 | QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSS (SEQ ID NO: 199) | RFAMH (SEQ ID NO: 157) | VISYDGGNKYYAESVKG (SEQ ID NO: 164) | GYDVLTGYPDY (SEQ ID NO: 195) |
| 101A, 101B, 101C, 101D, 101E, 101F, 101G | HV-102 | QVQLVESGGGVVQPGRSLRLSCAASGFTFSRFAMHWVRQAPGKGLEWVAVISYQGRNKYYAESVKGRFTISRDNSKNTLYLQMNSLRAEDTALFYCARGYDVLTGYPDYWGQGTLVTVSS (SEQ ID NO: 200) | RFAMH (SEQ ID NO: 157) | VISYQGRNKYYAESVKG (SEQ ID NO: 165) | GYDVLTGYPDY (SEQ ID NO: 195) |
| 102A, 102B, 102C, 102D | HV-103 | QVQLVESGGGVVQPGRSLRLSCAASGFTFSRFAMHWVRQAPGKGLEWVAVISYNGGNKYYAESVKGRFTISRDNSKNTLYLQMNSLRAEDTALFYCARGYDVLTGYPDYWGQGTLVTVSS (SEQ ID NO: 201) | RFAMH (SEQ ID NO: 157) | VISYNGGNKYYAESVKG (SEQ ID NO: 166) | GYDVLTGYPDY (SEQ ID NO: 195) |
| 103A, 103B | HV-104 | QVQLVESGGGVVQPGRSLRLSCAASGFTFSRFAMHWVRQAPGKGLEWVGVISFSGGSKYYAESVKGRFTLSRDNSKNTLYLQMNSLRAEDTALFYCARGYDVLTGYPDYWGQGTLVTVSS (SEQ ID NO: 202) | RFAMH (SEQ ID NO: 157) | VISFSGGSKYYAESVKG (SEQ ID NO: 167) | GYDVLTGYPDY (SEQ ID NO: 195) |
| 104A, 104B | HV-105 | QVQLVESGGGVVQPGRSLRLSCAASGFTFSRFAMHWVRQAPGKGLEWVGVINYRGHGKYYAESVKGRFTVSRDNSKNTLYLQMNSLRAEDTALFYCARGYDVLTGYPDYWGQGTLVTVSS (SEQ ID NO: 203) | RFAMH (SEQ ID NO: 157) | VINYRGHGKYYAESVKG (SEQ ID NO: 168) | GYDVLTGYPDY (SEQ ID NO: 195) |
| 105A, 105B | HV-106 | QVQLVESGGGVVQPGRSLRLSCAASGFTFSRFAMHWVRQAPGKGLEWVGVISYSGASKYYAESVKGRFTMSRDNSKNTLYLQMNSLRAEDTALFYCARGYDVLTGYPDYWGQGTLVTVSS (SEQ ID NO: 204) | RFAMH (SEQ ID NO: 157) | VISYSGASKYYAESVKG (SEQ ID NO: 169) | GYDVLTGYPDY (SEQ ID NO: 195) |
| 106A, 106B | HV-107 | QVQLVESGGGVVQPGRSLRLSCAASGFTFSRFAMHWVRQAPGKGLEWVAVISYSGAFKYYAESVKGRFTVSRDNSKNTLYLQMNSLRAEDTALFYCARGYDVLTGYPDYWGQGTLVTVSS (SEQ ID NO: 205) | RFAMH (SEQ ID NO: 157) | VISYSGAFKYYAESVKG (SEQ ID NO: 170) | GYDVLTGYPDY (SEQ ID NO: 195) |
| 107A, 107B | HV-108 | QVQLVESGGGVVQPGRSLRLSCAASGFTFSRFAMHWVRQAPGKGLEWVGVISYTGAQKYYAESVKGRFTMSRDNSKNTLYLQMNSLRAEDTALFYCARGYDVLTGYPDYWGQGTLVTVSS (SEQ ID NO: 206) | RFAMH (SEQ ID NO: 157) | VISYTGAQKYYAESVKG (SEQ ID NO: 171) | GYDVLTGYPDY (SEQ ID NO: 195) |
| 108A, 108B | HV-109 | QVQLVESGGGVVQPGRSLRLSCAASGFTFSRFAMHWVRQAPGKGLEWVGVISYTGQFKYYAESVKGRFTVSRDNSKNTLYLQMNSLRAEDTALFYCARGYDVLTGYPDYWGQGTLVTVSS (SEQ ID NO: 207) | RFAMH (SEQ ID NO: 157) | VISYTGQFKYYAESVKG (SEQ ID NO: 172) | GYDVLTGYPDY (SEQ ID NO: 195) |
| 109A, 109B | HV-110 | QVQLVESGGGVVQPGRSLRLSCAASGFTFSKYAMHWVRQAPGKGLEWVAVISYMGANKYYAESVKGRFTISRDNSKNTLYLQMNSLRAEDTALFYCARGYDLLTGYPDYWGQGTLVTVSS (SEQ ID NO: 208) | KYAMH (SEQ ID NO: 158) | VISYMGANKYYAESVKG (SEQ ID NO: 173) | GYDLLTGYPDY (SEQ ID NO: 196) |

TABLE 6B-continued

Exemplary Anti-Human PAC1 Receptor Antibody Heavy Chain Variable Region Amino Acid Sequences

| Antibody ID. | VH Group | VH Amino Acid Sequence | CDRH1 | CDRH2 | CDRH3 |
|---|---|---|---|---|---|
| 110A, 110B | HV-111 | QVQLVESGGGVVQPGRSLRLSCAASGFTFSRFAMHWVRQAPGKGLEWVGVINFQGTTKYYAESVKGRFTISRDNSKNTLYLQMNSLRAEDTALFYCARGYDVLTGYPDYWGQGTLVTVSS (SEQ ID NO: 209) | RFAMH (SEQ ID NO: 157) | VINFQGTTKYYAESVKG (SEQ ID NO: 174) | GYDVLTGYPDY (SEQ ID NO: 195) |
| 111A, 111B | HV-112 | QVQLVESGGGVVQPGRSLRLSCAASGFTFSRFAMHWVRQAPGKGLEWVGVISYSGDLKYYAESVKGRFTVSRDNSKNTLYLQMNSLRAEDTALFYCARGYDVLTGYPDYWGQGTLVTVSS (SEQ ID NO: 210) | RFAMH (SEQ ID NO: 157) | VISYSGDLKYYAESVKG (SEQ ID NO: 175) | GYDVLTGYPDY (SEQ ID NO: 195) |
| 112A, 112B | HV-113 | QVQLVESGGGVVQPGRSLRLSCAASGFTFSRFAMHWVRQAPGKGLEWVGVITYTGGAKYYAESVKGRFTISRDNSKNTLYLQMNSLRAEDTALFYCARGYDVLTGYPDYWGQGTLVTVSS (SEQ ID NO: 211) | RFAMH (SEQ ID NO: 157) | VITYTGGAKYYAESVKG (SEQ ID NO: 176) | GYDVLTGYPDY (SEQ ID NO: 195) |
| 113A, 113B | HV-114 | QVQLVESGGGVVQPGRSLRLSCAASGFTFSKYAMHWVRQAPGKGLEWVAVISYSGANKYYAESVKGRFTISRDNSKNTLYLQMNSLRAEDTALFYCARGYDLLTGYPDYWGQGTLVTVSS (SEQ ID NO: 212) | KYAMH (SEQ ID NO: 158) | VISYSGANKYYAESVKG (SEQ ID NO: 177) | GYDLLTGYPDY (SEQ ID NO: 196) |
| 114A, 114B | HV-115 | QVQLVESGGGVVQPGRSLRLSCAASGFTFSYYAMHWVRQAPGKGLEWVAVISHYGTNKYYAESVKGRFTISRDNSKNTLYLQMNSLRAEDTALFYCARGYDPLTGYPDYWGQGTLVTVSS (SEQ ID NO: 213) | YYAMH (SEQ ID NO: 159) | VISHYGTNKYYAESVKG (SEQ ID NO: 178) | GYDPLTGYPDY (SEQ ID NO: 197) |
| 115A, 115B | HV-116 | QVQLVESGGGVVQPGRSLRLSCAASGFTFSKYAMHWVRQAPGKGLEWVAVISYQGSNKYYAESVKGRFTISRDNSKNTLYLQMNSLRAEDTALFYCARGYDLLTGYPDYWGQGTLVTVSS (SEQ ID NO: 214) | HYAMH (SEQ ID NO: 160) | VISYQGSNKYYAESVKG (SEQ ID NO: 179) | GYDLLTGYPDY (SEQ ID NO: 196) |
| 116A, 116B | HV-117 | QVQLVESGGGVVQPGRSLRLSCAASGFTFSRFAMHWVRQAPGKGLEWVGVINYFGDAKYYAESVKGRFTISRDNSKNTLYLQMNSLRAEDTALFYCARGYDVLTGYPDYWGQGTLVTVSS (SEQ ID NO: 215) | RFAMH (SEQ ID NO: 157) | VINYFGDAKYYAESVKG (SEQ ID NO: 180) | GYDVLTGYPDY (SEQ ID NO: 195) |
| 117A, 117B | HV-118 | QVQLVESGGGVVQPGRSLRLSCAASGFTFSYFAMHWVRQAPGKGLEWVAVISHSGANKYYAESVKGRFTISRDNSKNTLYLQMNSLRAEDTALFYCARGYDLLSGYPDYWGQGTLVTVSS (SEQ ID NO: 216) | YFAMH (SEQ ID NO: 161) | VISHSGANKYYAESVKG (SEQ ID NO: 181) | GYDLLSGYPDY (SEQ ID NO: 198) |
| 118A, 118B | HV-119 | QVQLVESGGGVVQPGRSLRLSCAASGFTFSYYAMHWVRQAPGKGLEWVAVISYSGSNKYYAESVKGRFTISRDNSKNTLYLQMNSLRAEDTALFYCARGYDLLTGYPDYWGQGTLVTVSS (SEQ ID NO: 217) | YYAMH (SEQ ID NO: 159) | VISYSGSNKYYAESVKG (SEQ ID NO: 182) | GYDLLTGYPDY (SEQ ID NO: 196) |
| 119A, 119B | HV-120 | QVQLVESGGGVVQPGRSLRLSCAASGFTFSFYAMHWVRQAPGKGLEWVAVISSFGSNKYYAESVKGRFTISRDNSKNTLYLQMNSLRAEDTALFYCARGYDLLTGYPDYWGQGTLVTVSS (SEQ ID NO: 218) | FYAMH (SEQ ID NO: 162) | VISSFGSNKYYAESVKG (SEQ ID NO: 183) | GYDLLTGYPDY (SEQ ID NO: 196) |

TABLE 6B-continued

Exemplary Anti-Human PAC1 Receptor Antibody Heavy Chain Variable Region Amino Acid Sequences

| Antibody ID. | VH Group | VH Amino Acid Sequence | CDRH1 | CDRH2 | CDRH3 |
|---|---|---|---|---|---|
| 120A, 120B | HV-121 | QVQLVESGGGVVQPGRSLRLSCAASGFTFSRYAMHWVRQAPGKGLEWVAVISYSGANKYYAESVKGRFTISRDNSKNTLYLQMNSLRAEDTALFYCARGYDLLSGYPDYWGQGTLVTVSS (SEQ ID NO: 219) | RYAMH (SEQ ID NO: 163) | VISYSGANKYYAESVKG (SEQ ID NO: 177) | GYDLLSGYPDY (SEQ ID NO: 198) |
| 121A, 121B, 123A, 123B | HV-122 | QVQLVESGGGVVQPGRSLRLSCAASGFTFSRFAMHWVRQAPGKGLEWVAVISYIGGNKYYAESVKGRFTISRDNSKNTLYLQMNSLRAEDTALFYCARGYDVLTGYPDYWGQGTLVTVSS (SEQ ID NO: 220) | RFAMH (SEQ ID NO: 157) | VISYIGGNKYYAESVKG (SEQ ID NO: 184) | GYDVLTGYPDY (SEQ ID NO: 195) |
| 122A, 122B | HV-123 | QVQLVESGGGVVQPGRSLRLSCAASGFTFSYYAMHWVRQAPGKGLEWVAVISSMGTNKYYAESVKGRFTISRDNSKNTLYLQMNSLRAEDTALFYCARGYDVLTGYPDYWGQGTLVTVSS (SEQ ID NO: 221) | YYAMH (SEQ ID NO: 159) | VISSMGTNKYYAESVKG (SEQ ID NO: 185) | GYDVLTGYPDY (SEQ ID NO: 195) |
| 124A, 124B | HV-124 | QVQLVESGGGVVQPGRSLRLSCAASGFTFSRFAMHWVRQAPGKGLEWVAVISYNGRNKYYAESVKGRFTISRDNSKNTLYLQMNSLRAEDTALFYCARGYDVLTGYPDYWGQGTLVTVSS (SEQ ID NO: 222) | RFAMH (SEQ ID NO: 157) | VISYNGRNKYYAESVKG (SEQ ID NO: 186) | GYDVLTGYPDY (SEQ ID NO: 195) |
| 125A, 125B | HV-125 | QVQLVESGGGVVQPGRSLRLSCAASGFTFSRFAMHWVRQAPGKGLEWVAVISYIGRNKYYAESVKGRFTISRDNSKNTLYLQMNSLRAEDTALFYCARGYDVLTGYPDYWGQGTLVTVSS (SEQ ID NO: 223) | RFAMH (SEQ ID NO: 157) | VISYIGRNKYYAESVKG (SEQ ID NO: 187) | GYDVLTGYPDY (SEQ ID NO: 195) |
| 126A, 126B | HV-126 | QVQLVESGGGVVQPGRSLRLSCAASGFTFSRFAMHWVRQAPGKGLEWVAVISYNGGNKYYARSVKGRFTISRDNSKNTLYLQMNSLRAEDTALFYCARGYDVLTGYPDYWGQGTLVTVSS (SEQ ID NO: 224) | RFAMH (SEQ ID NO: 157) | VISYNGGNKYYARSVKG (SEQ ID NO: 188) | GYDVLTGYPDY (SEQ ID NO: 195) |
| 127 A, 127B | HV-127 | QVQLVESGGGVVQPGRSLRLSCAASGFTFSRFAMHWVRQAPGKGLEWVAVISYYGGNKYYARSVKGRFTISRDNSKNTLYLQMNSLRAEDTALFYCARGYDVLTGYPDYWGQGTLVTVSS (SEQ ID NO: 225) | RFAMH (SEQ ID NO: 157) | VISYYGGNKYYARSVKG (SEQ ID NO: 189) | GYDVLTGYPDY (SEQ ID NO: 195) |
| 128A, 128B | HV-128 | QVQLVESGGGVVQPGRSLRLSCAASGFTFSRFAMHWVRQAPGKGLEWVAVISYQGRNKYYARSVKGRFTISRDNSKNTLYLQMNSLRAEDTALFYCARGYDVLTGYPDYWGQGTLVTVSS (SEQ ID NO: 226) | RFAMH (SEQ ID NO: 157) | VISYQGRNKYYARSVKG (SEQ ID NO: 190) | GYDVLTGYPDY (SEQ ID NO: 195) |
| 129A, 129B | HV-129 | QVQLVESGGGVVQPGRSLRLSCAASGFTFSRFAMHWVRQAPGKGLEWVAVISYYGRNKYYARSVKGRFTISRDNSKNTLYLQMNSLRAEDTALFYCARGYDVLTGYPDYWGQGTLVTVSS (SEQ ID NO: 227) | RFAMH (SEQ ID NO: 157) | VISYYGRNKYYARSVKG (SEQ ID NO: 191) | GYDVLTGYPDY (SEQ ID NO: 195) |
| 130A, 130B | HV-130 | QVQLVESGGGVVQPGRSLRLSCAASGFTFSRFAMHWVRQAPGKGLEWVAVISYNGNNKYYARSVKGRFTISRDNSKNTLYLQMNSLRAEDTALFYCARGYDVLTGYPDYWGQGTLVTVSS (SEQ ID NO: 228) | RFAMH (SEQ ID NO: 157) | VISYNGNNKYYARSVKG (SEQ ID NO: 192) | GYDVLTGYPDY (SEQ ID NO: 195) |
| 131A, 131B | HV-131 | QVQLVESGGGVVQPGRSLRLSCAASGFTFSRFAMHWVRQAPGKGLEWVAVISYNGRNKYYARSVKGRF | RFAMH (SEQ ID NO: 157) | VISYNGRNKYYARSVKG (SEQ ID | GYDVLTGYPDY (SEQ ID NO: 195) |

TABLE 6B-continued

Exemplary Anti-Human PAC1 Receptor Antibody Heavy Chain Variable Region Amino Acid Sequences

| Antibody ID. | VH Group | VH Amino Acid Sequence | CDRH1 | CDRH2 | CDRH3 |
|---|---|---|---|---|---|
| | | TISRDNSKNTLYLQMNSLRAEDT ALFYCARGYDVLTGYPDYWGQG TLVTVSS (SEQ ID NO: 229) | | NO: 193) | |
| 132A, 132B | HV-132 | QVQLVESGGGVVQPGRSLRLSCA ASGFTFSRFAMHWVRQAPGKGLE WVAVISYIGRNKYYARSVKGRFT ISRDNSKNTLYLQMNSLRAEDTA LFYCARGYDVLTGYPDYWGQGT LVTVSS (SEQ ID NO: 230) | RFAMH (SEQ ID NO: 157) | VISYIGRNK YYARSVKG (SEQ ID NO: 194) | GYDVLTGY PDY (SEQ ID NO: 195) |

The anti-PAC1 receptor binding domain of the bispecific antigen binding proteins may comprise one or more of the CDRs presented in Table 6A (light chain CDRs; i.e. CDRLs) and Table 6B (heavy chain CDRs, i.e. CDRHs). For instance, in certain embodiments, the anti-PAC1 receptor binding domain comprises one or more light chain CDRs selected from (i) a CDRL1 selected from SEQ ID NOs: 130 to 140, (ii) a CDRL2 having the sequence of SEQ ID NO: 141, and (iii) a CDRL3 selected from SEQ ID NOs: 142 to 145. In these and other embodiments, the anti-PAC1 receptor binding domain comprises one or more heavy chain CDRs selected from (i) a CDRH1 selected from SEQ ID NOs: 157 to 163, (ii) a CDRH2 selected from SEQ ID NOs: 164 to 194, and (iii) a CDRH3 selected from SEQ ID NOs: 195 to 198.

In some embodiments, the anti-PAC1 receptor binding domain of the bispecific antigen binding proteins of the invention comprises a light chain variable region comprising a CDRL1, a CDRL2, and a CDRL3, wherein: (a) CDRL1, CDRL2, and CDRL3 have the sequence of SEQ ID NOs: 131, 141 and 142, respectively; (b) CDRL1, CDRL2, and CDRL3 have the sequence of SEQ ID NOs: 132, 141 and 142, respectively; (c) CDRL1, CDRL2, and CDRL3 have the sequence of SEQ ID NOs: 133, 141 and 142, respectively; (d) CDRL1, CDRL2, and CDRL3 have the sequence of SEQ ID NOs: 134, 141 and 142, respectively; (e) CDRL1, CDRL2, and CDRL3 have the sequence of SEQ ID NOs: 135, 141 and 142, respectively; (f) CDRL1, CDRL2, and CDRL3 have the sequence of SEQ ID NOs: 136, 141 and 143, respectively; (g) CDRL1, CDRL2, and CDRL3 have the sequence of SEQ ID NOs: 137, 141 and 143, respectively; (h) CDRL1, CDRL2, and CDRL3 have the sequence of SEQ ID NOs: 138, 141 and 144, respectively; (i) CDRL1, CDRL2, and CDRL3 have the sequence of SEQ ID NOs: 139, 141 and 145, respectively; or (j) CDRL1, CDRL2, and CDRL3 have the sequence of SEQ ID NOs: 140, 141 and 142, respectively.

In other embodiments, the anti-PAC1 receptor binding domain of the bispecific antigen binding proteins of the invention comprises a heavy chain variable region comprising a CDRH1, a CDRH2, and a CDRH3, wherein: (a) CDRH1, CDRH2, and CDRH3 have the sequence of SEQ ID NOs: 157, 165 and 195, respectively; (b) CDRH1, CDRH2, and CDRH3 have the sequence of SEQ ID NOs: 157, 166 and 195, respectively; (c) CDRH1, CDRH2, and CDRH3 have the sequence of SEQ ID NOs: 157, 167 and 195, respectively; (d) CDRH1, CDRH2, and CDRH3 have the sequence of SEQ ID NOs: 157, 168 and 195, respectively; (e) CDRH1, CDRH2, and CDRH3 have the sequence of SEQ ID NOs: 157, 169 and 195, respectively; (f) CDRH1, CDRH2, and CDRH3 have the sequence of SEQ ID NOs: 157, 170 and 195, respectively; (g) CDRH1, CDRH2, and CDRH3 have the sequence of SEQ ID NOs: 157, 171 and 195, respectively; (h) CDRH1, CDRH2, and CDRH3 have the sequence of SEQ ID NOs: 157, 172 and 195, respectively; (i) CDRH1, CDRH2, and CDRH3 have the sequence of SEQ ID NOs: 158, 173 and 196, respectively; (j) CDRH1, CDRH2, and CDRH3 have the sequence of SEQ ID NOs: 157, 174 and 195, respectively; (k) CDRH1, CDRH2, and CDRH3 have the sequence of SEQ ID NOs: 157, 175 and 195, respectively; (1) CDRH1, CDRH2, and CDRH3 have the sequence of SEQ ID NOs: 157, 176 and 195, respectively; (m) CDRH1, CDRH2, and CDRH3 have the sequence of SEQ ID NOs: 158, 177 and 196, respectively; (n) CDRH1, CDRH2, and CDRH3 have the sequence of SEQ ID NOs: 159, 178 and 197, respectively; (o) CDRH1, CDRH2, and CDRH3 have the sequence of SEQ ID NOs: 160, 179 and 196, respectively; (p) CDRH1, CDRH2, and CDRH3 have the sequence of SEQ ID NOs: 157, 180 and 195, respectively; (q) CDRH1, CDRH2, and CDRH3 have the sequence of SEQ ID NOs: 161, 181 and 198, respectively; (r) CDRH1, CDRH2, and CDRH3 have the sequence of SEQ ID NOs: 159, 182 and 196, respectively; (s) CDRH1, CDRH2, and CDRH3 have the sequence of SEQ ID NOs: 162, 183 and 196, respectively; (t) CDRH1, CDRH2, and CDRH3 have the sequence of SEQ ID NOs: 163, 177 and 198, respectively; (u) CDRH1, CDRH2, and CDRH3 have the sequence of SEQ ID NOs: 157, 184 and 195, respectively; (v) CDRH1, CDRH2, and CDRH3 have the sequence of SEQ ID NOs: 159, 185 and 195, respectively; (w) CDRH1, CDRH2, and CDRH3 have the sequence of SEQ ID NOs: 157, 186 and 195, respectively; (x) CDRH1, CDRH2, and CDRH3 have the sequence of SEQ ID NOs: 157, 187 and 195, respectively; (y) CDRH1, CDRH2, and CDRH3 have the sequence of SEQ ID NOs: 157, 188 and 195, respectively; (z) CDRH1, CDRH2, and CDRH3 have the sequence of SEQ ID NOs: 157, 189 and 195, respectively; (aa) CDRH1, CDRH2, and CDRH3 have the sequence of SEQ ID NOs: 157, 190 and 195, respectively; (ab) CDRH1, CDRH2, and CDRH3 have the sequence of SEQ ID NOs: 157, 191 and 195, respectively; (ac) CDRH1, CDRH2, and CDRH3 have the sequence of SEQ ID NOs: 157, 192 and 195, respectively; (ad) CDRH1, CDRH2, and CDRH3 have the sequence of SEQ ID NOs: 157, 193 and 195, respectively; or (ae) CDRH1, CDRH2, and CDRH3 have the sequence of SEQ ID NOs: 157, 194 and 195, respectively.

In certain embodiments, the anti-PAC1 receptor binding domain of the bispecific antigen binding proteins of the invention comprises a light chain variable region comprising a CDRL1, a CDRL2, and a CDRL3 and a heavy chain variable region comprising a CDRH1, a CDRH2, and a CDRH3, wherein:

(a) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 165 and 195, respectively;

(b) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 166 and 195, respectively;

(c) CDRL1, CDRL2, and CDRL3 have the sequence of SEQ ID NOs: 132, 141 and 142, respectively, and CDRH1, CDRH2, and CDRH3 have the sequence of SEQ ID NOs: 157, 167 and 195, respectively;

(d) CDRL1, CDRL2, and CDRL3 have the sequence of SEQ ID NOs: 132, 141 and 142, respectively, and CDRH1, CDRH2, and CDRH3 have the sequence of SEQ ID NOs: 157, 168 and 195, respectively;

(e) CDRL1, CDRL2, and CDRL3 have the sequence of SEQ ID NOs: 132, 141 and 142, respectively, and CDRH1, CDRH2, and CDRH3 have the sequence of SEQ ID NOs: 157, 169 and 195, respectively;

(f) CDRL1, CDRL2, and CDRL3 have the sequence of SEQ ID NOs: 132, 141 and 142, respectively, and CDRH1, CDRH2, and CDRH3 have the sequence of SEQ ID NOs: 157, 170 and 195, respectively;

(g) CDRL1, CDRL2, and CDRL3 have the sequence of SEQ ID NOs: 132, 141 and 142, respectively, and CDRH1, CDRH2, and CDRH3 have the sequence of SEQ ID NOs: 157, 171 and 195, respectively;

(h) CDRL1, CDRL2, and CDRL3 have the sequence of SEQ ID NOs: 133, 141 and 142, respectively, and CDRH1, CDRH2, and CDRH3 have the sequence of SEQ ID NOs: 157, 172 and 195, respectively;

(i) CDRL1, CDRL2, and CDRL3 have the sequence of SEQ ID NOs: 132, 141 and 142, respectively, and CDRH1, CDRH2, and CDRH3 have the sequence of SEQ ID NOs: 158, 173 and 196, respectively;

(j) CDRL1, CDRL2, and CDRL3 have the sequence of SEQ ID NOs: 132, 141 and 142, respectively, and CDRH1, CDRH2, and CDRH3 have the sequence of SEQ ID NOs: 157, 174 and 195, respectively;

(k) CDRL1, CDRL2, and CDRL3 have the sequence of SEQ ID NOs: 132, 141 and 142, respectively, and CDRH1, CDRH2, and CDRH3 have the sequence of SEQ ID NOs: 157, 175 and 195, respectively;

(l) CDRL1, CDRL2, and CDRL3 have the sequence of SEQ ID NOs: 134, 141 and 142, respectively, and CDRH1, CDRH2, and CDRH3 have the sequence of SEQ ID NOs: 157, 176 and 195, respectively;

(m) CDRL1, CDRL2, and CDRL3 have the sequence of SEQ ID NOs: 135, 141 and 142, respectively, and CDRH1, CDRH2, and CDRH3 have the sequence of SEQ ID NOs: 158, 177 and 196, respectively;

(n) CDRL1, CDRL2, and CDRL3 have the sequence of SEQ ID NOs: 135, 141 and 142, respectively, and CDRH1, CDRH2, and CDRH3 have the sequence of SEQ ID NOs: 159, 178 and 197, respectively;

(o) CDRL1, CDRL2, and CDRL3 have the sequence of SEQ ID NOs: 136, 141 and 143, respectively, and CDRH1, CDRH2, and CDRH3 have the sequence of SEQ ID NOs: 160, 179 and 196, respectively;

(p) CDRL1, CDRL2, and CDRL3 have the sequence of SEQ ID NOs: 132, 141 and 142, respectively, and CDRH1, CDRH2, and CDRH3 have the sequence of SEQ ID NOs: 157, 180 and 195, respectively;

(q) CDRL1, CDRL2, and CDRL3 have the sequence of SEQ ID NOs: 135, 141 and 142, respectively, and CDRH1, CDRH2, and CDRH3 have the sequence of SEQ ID NOs: 161, 181 and 198, respectively;

(r) CDRL1, CDRL2, and CDRL3 have the sequence of SEQ ID NOs: 135, 141 and 142, respectively, and CDRH1, CDRH2, and CDRH3 have the sequence of SEQ ID NOs: 159, 182 and 196, respectively;

(s) CDRL1, CDRL2, and CDRL3 have the sequence of SEQ ID NOs: 135, 141 and 142, respectively, and CDRH1, CDRH2, and CDRH3 have the sequence of SEQ ID NOs: 162, 183 and 196, respectively;

(t) CDRL1, CDRL2, and CDRL3 have the sequence of SEQ ID NOs: 137, 141 and 143, respectively, and CDRH1, CDRH2, and CDRH3 have the sequence of SEQ ID NOs: 163, 177 and 198, respectively;

(u) CDRL1, CDRL2, and CDRL3 have the sequence of SEQ ID NOs: 138, 141 and 144, respectively, and CDRH1, CDRH2, and CDRH3 have the sequence of SEQ ID NOs: 157, 184 and 195, respectively;

(v) CDRL1, CDRL2, and CDRL3 have the sequence of SEQ ID NOs: 139, 141 and 145, respectively, and CDRH1, CDRH2, and CDRH3 have the sequence of SEQ ID NOs: 159, 185 and 195, respectively;

(w) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 184 and 195, respectively;

(x) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 186 and 195, respectively;

(y) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 187 and 195, respectively;

(z) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 188 and 195, respectively;

(aa) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 189 and 195, respectively;

(ab) CDRL1, CDRL2, and CDRL3 have the sequence of SEQ ID NOs: 140, 141 and 142, respectively, and CDRH1, CDRH2, and CDRH3 have the sequence of SEQ ID NOs: 157, 190 and 195, respectively;

(ac) CDRL1, CDRL2, and CDRL3 have the sequence of SEQ ID NOs: 140, 141 and 142, respectively, and CDRH1, CDRH2, and CDRH3 have the sequence of SEQ ID NOs: 157, 191 and 195, respectively;

(ad) CDRL1, CDRL2, and CDRL3 have the sequence of SEQ ID NOs: 140, 141 and 142, respectively, and CDRH1, CDRH2, and CDRH3 have the sequence of SEQ ID NOs: 157, 192 and 195, respectively;

(ae) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 193 and 195, respectively; or (af) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 194 and 195, respectively.

In some embodiments, the anti-PAC1 receptor binding domain of the bispecific antigen binding proteins of the invention comprises a light chain variable region comprising a CDRL1, a CDRL2, and a CDRL3 and a heavy chain variable region comprising a CDRH1, a CDRH2, and a CDRH3, wherein:

(a) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 165 and 195, respectively;

(b) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 166 and 195, respectively;

(c) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 184 and 195, respectively;

(d) CDRL1, CDRL2, and CDRL3 have the sequence of SEQ ID NOs: 131, 141 and 142, respectively, and CDRH1, CDRH2, and CDRH3 have the sequence of SEQ ID NOs: 157, 186 and 195, respectively;

(e) CDRL1, CDRL2, and CDRL3 have the sequence of SEQ ID NOs: 132, 141 and 142, respectively, and CDRH1, CDRH2, and CDRH3 have the sequence of SEQ ID NOs: 157, 175 and 195, respectively;

(f) CDRL1, CDRL2, and CDRL3 have the sequence of SEQ ID NOs: 135, 141 and 142, respectively, and CDRH1, CDRH2, and CDRH3 have the sequence of SEQ ID NOs: 158, 177 and 196, respectively;

(g) CDRL1, CDRL2, and CDRL3 have the sequence of SEQ ID NOs: 132, 141 and 142, respectively, and CDRH1, CDRH2, and CDRH3 have the sequence of SEQ ID NOs: 157, 174 and 195, respectively;

(h) CDRL1, CDRL2, and CDRL3 have the sequence of SEQ ID NOs: 133, 141 and 142, respectively, and CDRH1, CDRH2, and CDRH3 have the sequence of SEQ ID NOs: 157, 172 and 195, respectively;

(i) CDRL1, CDRL2, and CDRL3 have the sequence of SEQ ID NOs: 132, 141 and 142, respectively, and CDRH1, CDRH2, and CDRH3 have the sequence of SEQ ID NOs: 157, 170 and 195, respectively; or (j) CDRL1, CDRL2, and CDRL3 have the sequence of SEQ ID NOs: 132, 141 and 142, respectively, and CDRH1, CDRH2, and CDRH3 have the sequence of SEQ ID NOs: 157, 168 and 195, respectively.

The anti-PAC1 receptor binding domain of the bispecific antigen binding proteins of the invention may comprise a light chain variable region selected from the group consisting of LV-101, LV-102, LV-103, LV-104, LV-105, LV-106, LV-107, LV-108, LV-109, LV-110, and LV-111, as shown in Table 6A, and/or a heavy chain variable region selected from the group consisting of HV-101, HV-102, HV-103, HV-104, HV-105, HV-106, HV-107, HV-108, HV-109, HV-110, HV-111, HV-112, HV-113, HV-114, HV-115, HV-116, HV-117, HV-118, HV-119, HV-120, HV-121, HV-122, HV-123, HV-124, HV-125, HV-126, HV-127, HV-128, HV-129, HV-130, HV-131, and HV-132 as shown in Table 6B, and antigen-binding fragments, derivatives, muteins and variants of these light chain and heavy chain variable regions. Each of the light chain variable regions listed in Table 6A may be combined with any of the heavy chain variable regions shown in Table 6B to form an anti-PAC1 receptor binding domain suitable for incorporation into the bispecific antigen binding proteins of the invention. For instance, in certain embodiments, the anti-PAC1 receptor binding domain comprises a light chain variable region and a heavy chain variable region, wherein: (a) the light chain variable region comprises the sequence of SEQ ID NO: 147 and the heavy chain variable region comprises the sequence of SEQ ID NO: 200; (b) the light chain variable region comprises the sequence of SEQ ID NO: 147 and the heavy chain variable region comprises the sequence of SEQ ID NO: 201; (c) the light chain variable region comprises the sequence of SEQ ID NO: 148 and the heavy chain variable region comprises the sequence of SEQ ID NO: 202; (d) the light chain variable region comprises the sequence of SEQ ID NO: 148 and the heavy chain variable region comprises the sequence of SEQ ID NO: 203; (e) the light chain variable region comprises the sequence of SEQ ID NO: 148 and the heavy chain variable region comprises the sequence of SEQ ID NO: 204; (f) the light chain variable region comprises the sequence of SEQ ID NO: 148 and the heavy chain variable region comprises the sequence of SEQ ID NO: 205; (g) the light chain variable region comprises the sequence of SEQ ID NO: 148 and the heavy chain variable region comprises the sequence of SEQ ID NO: 206; (h) the light chain variable region comprises the sequence of SEQ ID NO: 149 and the heavy chain variable region comprises the sequence of SEQ ID NO: 207; (i) the light chain variable region comprises the sequence of SEQ ID NO: 148 and the heavy chain variable region comprises the sequence of SEQ ID NO: 208; (j) the light chain variable region comprises the sequence of SEQ ID NO: 148 and the heavy chain variable region comprises the sequence of SEQ ID NO: 209; (k) the light chain variable region comprises the sequence of SEQ ID NO: 148 and the heavy chain variable region comprises the sequence of SEQ ID NO: 210; (1) the light chain variable region comprises the sequence of SEQ ID NO: 150 and the heavy chain variable region comprises the sequence of SEQ ID NO: 211; (m) the light chain variable region comprises the sequence of SEQ ID NO: 151 and the heavy chain variable region comprises the sequence of SEQ ID NO: 212; (n) the light chain variable region comprises the sequence of SEQ ID NO: 151 and the heavy chain variable region comprises the sequence of SEQ ID NO: 213; (o) the light chain variable region comprises the sequence of SEQ ID NO: 152 and the heavy chain variable region comprises the sequence of SEQ ID NO: 214; (p) the light chain variable region comprises the sequence of SEQ ID NO: 148 and the heavy chain variable region comprises the sequence of SEQ ID NO: 215; (q) the light chain variable region comprises the sequence of SEQ ID NO: 151 and the heavy chain variable region comprises the sequence of SEQ ID NO: 216; (r) the light chain variable region comprises the sequence of SEQ ID NO: 151 and the heavy chain variable region comprises the sequence of SEQ ID NO: 217; (s) the light chain variable region comprises the sequence of SEQ ID NO: 151 and the heavy chain variable region comprises the sequence of SEQ ID NO: 218; (t) the light chain variable region comprises the sequence of SEQ ID NO: 153 and the heavy chain variable region comprises the sequence of SEQ ID NO: 219; (u) the light chain variable region comprises the sequence of SEQ ID NO: 154 and the heavy chain variable region comprises the sequence of SEQ ID NO: 220; (v) the light chain variable region comprises the sequence of SEQ ID NO: 155 and the heavy chain variable region comprises the sequence of SEQ ID NO: 221; (w) the light chain variable region comprises the sequence of SEQ ID NO: 147 and the heavy chain variable region comprises the sequence of SEQ ID NO: 220; (x) the light chain variable region comprises the sequence of SEQ ID NO: 147 and the heavy chain variable region comprises the sequence of SEQ ID NO: 222; (y) the light chain variable region comprises the sequence of SEQ ID NO: 147 and the heavy chain variable region comprises the sequence of SEQ ID NO: 223; (z) the light chain variable region comprises the sequence of SEQ ID NO: 147 and the heavy chain variable region comprises the sequence of SEQ ID NO: 224; (aa) the light chain variable region comprises the sequence of SEQ ID NO: 147 and the heavy chain variable region comprises the sequence of SEQ ID NO: 225; (ab) the light chain variable region comprises the sequence of SEQ ID NO: 156 and the heavy chain variable region comprises the sequence of SEQ ID NO: 226; (ac) the light chain variable region comprises the sequence of SEQ ID NO: 156 and the heavy chain variable region comprises the sequence of SEQ ID NO: 227; (ad) the light chain variable region comprises the sequence of SEQ ID NO: 156 and the heavy chain variable region comprises the sequence of SEQ ID NO: 228; (ae) the light chain variable region comprises the sequence of SEQ ID NO: 147 and the heavy chain variable region comprises the sequence of SEQ ID NO: 229; or (af) the light chain variable region comprises the sequence of SEQ ID NO: 147 and the heavy chain variable region comprises the sequence of SEQ ID NO: 230.

In some embodiments, the anti-PAC1 receptor binding domain comprises a light chain variable region comprising a sequence of contiguous amino acids that differs from the sequence of a light chain variable region in Table 6A, i.e. a VL selected from LV-101, LV-102, LV-103, LV-104, LV-105, LV-106, LV-107, LV-108, LV-109, LV-110, and LV-111 at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The light chain variable region in some anti-PAC1 receptor binding domains comprises a sequence of amino acids that has at least 70%, at least 75%, at least 80%, at least 85%, at least 90%, at least 95%, at least 97% or at least 99% sequence identity to the amino acid sequences of SEQ ID NOs: 147-156 (i.e. the light chain variable regions in Table 6A). In one embodiment, the anti-PAC1 receptor binding domain comprises a light chain variable region that comprises a sequence that is at least 90% identical to an amino acid sequence selected from SEQ ID NOs: 147-156. In another embodiment, the anti-PAC1 receptor binding domain comprises a light chain variable region that comprises a sequence that is at least 95% identical to an amino acid sequence selected from SEQ ID NOs: 147-156.

In these and other embodiments, the anti-PAC1 receptor binding domain comprises a heavy chain variable region comprising a sequence of contiguous amino acids that differs from the sequence of a heavy chain variable region in Table 6B, i.e., a VH selected from HV-101, HV-102, HV-103, HV-104, HV-105, HV-106, HV-107, HV-108, HV-109, HV-110, HV-111, HV-112, HV-113, HV-114, HV-115, HV-116, HV-117, HV-118, HV-119, HV-120, HV-121, HV-122, HV-123, HV-124, HV-125, HV-126, HV-127, HV-128, HV-129, HV-130, HV-131, and HV-132 at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The heavy chain variable region in some anti-PAC1 receptor binding domains comprises a sequence of amino acids that has at least 70%, at least 75%, at least 80%, at least 85%, at least 90%, at least 95%, at least 97% or at least 99% sequence identity to the amino acid sequences of SEQ ID NOs: 200-230 (i.e. the heavy chain variable regions in Table 6B). In one embodiment, the anti-PAC1 receptor binding domain comprises a heavy chain variable region that comprises a sequence that is at least 90% identical to an amino acid sequence selected from SEQ ID NOs: 200-230. In another embodiment, the anti-PAC1 receptor binding domain comprises a heavy chain variable region that comprises a sequence that is at least 95% identical to an amino acid sequence selected from SEQ ID NOs: 200-230.

In certain embodiments, the bispecific antigen binding proteins of the invention are antibodies. In particular embodiments, the bispecific antigen binding proteins of the invention are heterodimeric antibodies (used interchangeably herein with “hetero immunoglobulins” or “hetero Igs”), which refer to antibodies comprising two different light chains and two different heavy chains. For instance, in some embodiments, the heterodimeric antibody comprises a light chain and heavy chain from an anti-PAC1 receptor antibody and a light chain and heavy chain from an anti-CGRP receptor antibody. See FIG. 2. As described in Example 3, the hetero-immunoglobulin format for bispecific molecules with target specificities for human CGRP receptor and human PAC1 receptor has a more desirable pharmacokinetic profile than molecules having a bivalent, bispecific format, such as the IgG-Fab format.

The heterodimeric antibodies can comprise any immunoglobulin constant region, such as the light chain and heavy chain constant regions shown in Tables 3 and 4, respectively. The heavy chain constant region of the heterodimeric antibodies can be, for example, an alpha-, delta-, epsilon-, gamma-, or mu-type heavy chain constant region, e.g., a human alpha-, delta-, epsilon-, gamma-, or mu-type heavy chain constant region. In some embodiments, the heterodimeric antibodies comprise a heavy chain constant region from an IgG1, IgG2, IgG3, or IgG4 immunoglobulin. In one embodiment, the heterodimeric antibody comprises a heavy chain constant region from a human IgG1 immunoglobulin. In such embodiments, the human IgG1 immunoglobulin constant region may comprise one or more mutations to prevent glycosylation of the heterodimeric antibody as described in more detail herein. In another embodiment, the heterodimeric antibody comprises a heavy chain constant region from a human IgG2 immunoglobulin. In yet another embodiment, the heterodimeric antibody comprises a heavy chain constant region from a human IgG4 immunoglobulin.

Each of the variable regions disclosed in Tables 2A, 2B, 6A, and 6B may be attached to the light and heavy chain constant regions in Tables 3 and 4 to form complete antibody light and heavy chains, respectively. Further, each of the so generated heavy and light chain polypeptides may be combined to form a complete bispecific antibody structure, e.g. a heterodimeric antibody. It should be understood that the heavy chain and light chain variable regions provided herein can also be attached to other constant domains having different sequences than the exemplary sequences listed in Tables 3 and 4.

To facilitate assembly of the light and heavy chains from the anti-CGRP receptor antibody and the light and heavy chains from the anti-PAC1 receptor antibody into a bispecific, heterodimeric antibody, the light chains and/or heavy chains from each antibody can be engineered to reduce the formation of mispaired molecules. For example, one approach to promote heterodimer formation over homodimer formation is the so-called “knobs-into-holes” method, which involves introducing mutations into the CH3 domains of two different antibody heavy chains at the contact interface. Specifically, one or more bulky amino acids in one heavy chain are replaced with amino acids having short side chains (e.g. alanine or threonine) to create a “hole,” whereas one or more amino acids with large side chains (e.g. tyrosine or tryptophan) are introduced into the other heavy chain to create a "knob." When the modified heavy chains are co-expressed, a greater percentage of heterodimers (knob-hole) are formed as compared to homodimers (hole-hole or knob-knob). The "knobs-into-holes" methodology is described in detail in WO 96/027011; Ridgway et al., Protein Eng., Vol. 9: 617-621, 1996; and Merchant et al., Nat, Biotechnol., Vol. 16: 677-681, 1998, all of which are hereby incorporated by reference in their entireties.

Another approach for promoting heterodimer formation to the exclusion of homodimer formation entails utilizing an electrostatic steering mechanism (see Gunasekaran et al., J. Biol. Chem., Vol. 285: 19637-19646, 2010, which is hereby incorporated by reference in its entirety). This approach involves introducing or exploiting charged residues in the CH3 domain in each heavy chain so that the two different heavy chains associate through opposite charges that cause electrostatic attraction. Homodimerization of the identical heavy chains are disfavored because the identical heavy chains have the same charge and therefore are repelled. This same electrostatic steering technique can be used to prevent mispairing of light chains with the non-cognate heavy chains by introducing residues having opposite charges in the correct light chain-heavy chain pair at the binding interface. The electrostatic steering technique and suitable charge pair mutations for promoting heterodimers and correct light chain/heavy chain pairing is described in WO2009089004 and WO2014081955, both of which are hereby incorporated by reference in their entireties.

In embodiments in which the bispecific antigen binding proteins of the invention are heterodimeric antibodies comprising a first light chain (LC1) and first heavy chain (HC1) from a first antibody that specifically binds to human CGRP receptor and a second light chain (LC2) and second heavy chain (HC2) from a second antibody that specifically binds to human PAC1 receptor, HC1 or HC2 may comprise one or more amino acid substitutions to replace a positively-charged amino acid with a negatively-charged amino acid. For instance, in one embodiment, the CH3 domain of HC1 or the CH3 domain of HC2 comprises an amino acid sequence differing from a wild-type IgG amino acid sequence such that one or more positively-charged amino acids (e.g., lysine, histidine and arginine) in the wild-type human IgG amino acid sequence are replaced with one or more negatively-charged amino acids (e.g., aspartic acid and glutamic acid) at the corresponding position(s) in the CH3 domain. In these and other embodiments, amino acids (e.g. lysine) at one or more positions selected from 360, 370, 392, 409, and 439 according to the EU numbering system are replaced with a negatively-charged amino acid (e.g., aspartic acid and glutamic acid). Unless indicated otherwise by reference to a specific sequence, throughout the present specification and claims, the numbering of the residues in an immunoglobulin heavy chain or light chain is according to Kabat-EU numbering as described in Kabat et al., Sequences of Proteins of Immunological Interest, 5th Ed. Public Health Service, National Institutes of Health Publication No. 91-3242, Bethesda, MD (1991) and Edelman et al., Proc. Natl. Acad. USA, Vol. 63: 78-85 (1969).

An amino acid substitution in an amino acid sequence is typically designated herein with a one-letter abbreviation for the amino acid residue in a particular position, followed by the numerical amino acid position relative to an original sequence of interest, which is then followed by the one-letter symbol for the amino acid residue substituted in. For example, "T30D" symbolizes a substitution of a threonine residue by an aspartate residue at amino acid position 30, relative to the original sequence of interest. Another example, "5218G" symbolizes a substitution of a serine residue by a glycine residue at amino acid position 218, relative to the original amino acid sequence of interest.

In certain embodiments, HC1 or HC2 of the heterodimeric antibodies may comprise one or more amino acid substitutions to replace a negatively-charged amino acid with a positively-charged amino acid. For instance, in one embodiment, the CH3 domain of HC1 or the CH3 domain of HC2 comprises an amino acid sequence differing from wild-type IgG amino acid sequence such that one or more negatively-charged amino acids in the wild-type human IgG amino acid sequence are replaced with one or more positively-charged amino acids at the corresponding position(s) in the CH3 domain. In these and other embodiments, amino acids (e.g., aspartic acid or glutamic acid) at one or more positions selected from 356, 357, and 399 according to the EU numbering system of the CH3 domain are replaced with a positively-charged amino acid (e.g., lysine, histidine and arginine).

In particular embodiments, the heterodimeric antibody comprises a first heavy chain comprising negatively-charged amino acids at positions 392 and 409 (e.g., K392D and K409D substitutions), and a second heavy chain comprising positively-charged amino acids at positions 356 and 399 (e.g., E356K and D399K substitutions). In other particular embodiments, the heterodimeric antibody comprises a first heavy chain comprising negatively-charged amino acids at positions 370, 392, and 409 (e.g., K370D, K392D, and K409D substitutions), and a second heavy chain comprising positively-charged amino acids at positions 356, 357, and 399 (e.g., E356K, E357K, and D399K substitutions). In certain embodiments, the heterodimeric antibody comprises a first heavy chain comprising negatively-charged amino acids at positions 392, 409, and 439 (e.g., K392D, K409D, and K439D substitutions), and a second heavy chain comprising positively-charged amino acids at positions 356 and 399 (e.g., E356K and D399K substitutions). In other embodiments, the heterodimeric antibody comprises a first heavy chain comprising negatively-charged amino acids at positions 360, 370, 392, and 409 (e.g., K360E, K370E, K392E, and K409D substitutions), and a second heavy chain comprising positively-charged amino acids at positions 357 and 399 (e.g., E357K and D399K substitutions). In any of the foregoing embodiments, the first heavy chain can be from an anti-PAC1 receptor antibody and the second heavy chain can be from an anti-CGRP receptor antibody. Alternatively, in any of the foregoing embodiments, the first heavy chain can be from an anti-CGRP receptor antibody and the second heavy chain can be from an anti-PAC1 receptor antibody.

To facilitate the association of a particular heavy chain with its cognate light chain, both the heavy and light chains may contain complimentary amino acid substitutions. As used herein, "complimentary amino acid substitutions" refer to a substitution to a positively-charged amino acid in one chain paired with a negatively-charged amino acid substitution in the other chain. For example, in some embodiments, the heavy chain comprises at least one amino acid substitution to introduce a charged amino acid and the corresponding light chain comprises at least one amino acid substitution to introduce a charged amino acid, wherein the charged amino acid introduced into the heavy chain has the opposite charge of the amino acid introduced into the light chain. In certain embodiments, one or more positively-charged residues (e.g., lysine, histidine or arginine) can be introduced into a first light chain (LC1) and one or more negatively-charged residues (e.g., aspartic acid or glutamic acid) can be introduced into the companion heavy chain (HC1) at the binding interface of LC1/HC1, whereas one or more negatively-charged residues (e.g., aspartic acid or glutamic acid) can be introduced into a second light chain (LC2) and one or more positively-charged residues (e.g., lysine, histidine or arginine) can be introduced into the companion heavy chain (HC2) at the binding interface of LC2/HC2. The electrostatic interactions will direct the LC1 to pair with HC1 and LC2 to pair with HC2, as the opposite charged residues (polarity) at the interface attract. The heavy/light chain pairs having the same charged residues (polarity) at an interface (e.g. LC1/HC2 and LC2/HC1) will repel, resulting in suppression of the unwanted HC/LC pairings.

In these and other embodiments, the CH1 domain of the heavy chain or the CL domain of the light chain comprises an amino acid sequence differing from wild-type IgG amino acid sequence such that one or more positively-charged amino acids in wild-type IgG amino acid sequence is replaced with one or more negatively-charged amino acids. Alternatively, the CH1 domain of the heavy chain or the CL domain of the light chain comprises an amino acid sequence differing from wild-type IgG amino acid sequence such that one or more negatively-charged amino acids in wild-type IgG amino acid sequence is replaced with one or more positively-charged amino acids. In some embodiments, one or more amino acids in the CH1 domain of the first and/or second heavy chain in the heterodimeric antibody at an EU position selected from F126, P127, L128, A141, L145, K147, D148, H168, F170, P171, V173, Q175, S176, S183, V185 and K213 is replaced with a charged amino acid. In certain embodiments, a preferred residue for substitution with a negatively- or positively-charged amino acid is S183, with the amino acid position according to the EU numbering system. In some embodiments, S183 is substituted with a positively-charged amino acid. In alternative embodiments, S183 is substituted with a negatively-charged amino acid. For instance, in one embodiment, S183 is substituted with a negatively-charged amino acid (e.g. S183E) in the first heavy chain, and 5183 is substituted with a positively-charged amino acid (e.g. S183K) in the second heavy chain.

In embodiments in which the light chain is a kappa light chain, one or more amino acids in the CL domain of the first and/or second light chain in the heterodimeric antibody at a position according to EU and Kabat numbering in a kappa light chain selected from F116, F118, S121, D122, E123, Q124, S131, V133, L135, N137, N138, Q160, S162, T164, S174 and S176 is replaced with a charged amino acid. In embodiments in which the light chain is a lambda light chain, one or more amino acids in the CL domain of the first and/or second light chain in the heterodimeric antibody at a position according to Kabat numbering in a lambda chain selected from T116, F118, S121, E123, E124, K129, T131, V133, L135, S137, E160, T162, S165, Q167, A174, S176 and Y178 is replaced with a charged amino acid. In some embodiments, a preferred residue for substitution with a negatively- or positively-charged amino acid is S176 (EU and Kabat numbering system) of the CL domain of either a kappa or lambda light chain. In certain embodiments, S176 of the CL domain is replaced with a positively-charged amino acid. In alternative embodiments, S176 of the CL domain is replaced with a negatively-charged amino acid. In one embodiment, S176 is substituted with a positively-charged amino acid (e.g. S176K) in the first light chain, and S176 is substituted with a negatively-charged amino acid (e.g. S176E) in the second light chain.

In addition to or as an alternative to the complimentary amino acid substitutions in the CH1 and CL domains, the variable regions of the light and heavy chains in the heterodimeric antibody may contain one or more complimentary amino acid substitutions to introduce charged amino acids. For instance, in some embodiments, the VH region of the heavy chain or the VL region of the light chain of a heterodimeric antibody comprises an amino acid sequence differing from wild-type IgG amino acid sequence such that one or more positively-charged amino acids in wild-type IgG amino acid sequence is replaced with one or more negatively-charged amino acids. Alternatively, the VH region of the heavy chain or the VL region of the light chain comprises an amino acid sequence differing from wild-type IgG amino acid sequence such that one or more negatively-charged amino acids in wild-type IgG amino acid sequence is replaced with one or more positively-charged amino acids.

V region interface residues (i.e., amino acid residues that mediate assembly of the VH and VL regions) within the VH region include Kabat positions 1, 3, 35, 37, 39, 43, 44, 45, 46, 47, 50, 59, 89, 91, and 93. One or more of these interface residues in the VH region can be substituted with a charged (positively- or negatively-charged) amino acid. In certain embodiments, the amino acid at Kabat position 39 in the VH region of the first and/or second heavy chain is substituted with a positively-charged amino acid, e.g., lysine. In alternative embodiments, the amino acid at Kabat position 39 in the VH region of the first and/or second heavy chain is substituted with a negatively-charged amino acid, e.g., glutamic acid. In some embodiments, the amino acid at Kabat position 39 in the VH region of the first heavy chain is substituted with a negatively-charged amino acid (e.g. G39E), and the amino acid at Kabat position 39 in the VH region of the second heavy chain is substituted with a positively-charged amino acid (e.g. G39K). In some embodiments, the amino acid at Kabat position 44 in the VH region of the first and/or second heavy chain is substituted with a positively-charged amino acid, e.g., lysine. In alternative embodiments, the amino acid at Kabat position 44 in the VH region of the first and/or second heavy chain is substituted with a negatively-charged amino acid, e.g., glutamic acid. In certain embodiments, the amino acid at Kabat position 44 in the VH region of the first heavy chain is substituted with a negatively-charged amino acid (e.g. G44E), and the amino acid at Kabat position 44 in the VH region of the second heavy chain is substituted with a positively-charged amino acid (e.g. G44K).

V region interface residues (i.e., amino acid residues that mediate assembly of the VH and VL regions) within the VL region include Kabat positions 32, 34, 35, 36, 38, 41, 42, 43, 44, 45, 46, 48, 49, 50, 51, 53, 54, 55, 56, 57, 58, 85, 87, 89, 90, 91, and 100. One or more interface residues in the VL region can be substituted with a charged amino acid, preferably an amino acid that has an opposite charge to those introduced into the VH region of the cognate heavy chain. In some embodiments, the amino acid at Kabat position 100 in the VL region of the first and/or second light chain is substituted with a positively-charged amino acid, e.g., lysine. In alternative embodiments, the amino acid at Kabat position 100 in the VL region of the first and/or second light chain is substituted with a negatively-charged amino acid, e.g., glutamic acid. In certain embodiments, the amino acid at Kabat position 100 in the VL region of the first light chain is substituted with a positively-charged amino acid (e.g. G100K), and the amino acid at Kabat position 100 in the VL region of the second light chain is substituted with a negatively-charged amino acid (e.g. G100E).

In certain embodiments, a heterodimeric antibody of the invention comprises a first heavy chain, a second heavy chain, a first light chain, and a second light chain, wherein the first heavy chain comprises amino acid substitutions at positions 44 (Kabat numbering), 183 (EU numbering), 392 (EU numbering) and 409 (EU numbering), wherein the second heavy chain comprises amino acid substitutions at positions 44 (Kabat numbering), 183 (EU numbering), 356 (EU numbering) and 399 (EU numbering), wherein the first and second light chains comprise an amino acid substitution at positions 100 (Kabat numbering) and 176 (Kabat numbering), and wherein the amino acid substitutions introduce a charged amino acid at said positions. In related embodiments, the glycine at position 44 (Kabat numbering) of the first heavy chain is replaced with glutamic acid, the glycine at position 44 (Kabat numbering) of the second heavy chain is replaced with lysine, the glycine at position 100 (Kabat numbering) of the first light chain is replaced with lysine, the glycine at position 100 (Kabat numbering) of the second light chain is replaced with glutamic acid, the serine at position 176 (Kabat numbering) of the first light chain is replaced with lysine, the serine at position 176 (Kabat numbering) of the second light chain is replaced with glutamic acid, the serine at position 183 (EU numbering) of the first heavy chain is replaced with glutamic acid, the lysine at position 392 (EU numbering) of the first heavy chain is replaced with aspartic acid, the lysine at position 409 (EU numbering) of the first heavy chain is replaced with aspartic acid, the serine at position 183 (EU numbering) of the second heavy chain is replaced with lysine, the glutamic acid at position 356 (EU numbering) of the second heavy chain is replaced with lysine, and/or the aspartic acid at position 399 (EU numbering) of the second heavy chain is replaced with lysine. Accordingly, in some embodiments, the heterodimeric antibody comprises a first heavy chain, a first light chain, a second heavy chain, and a second light chain, wherein (a) the first heavy chain comprises amino acid substitutions G44E, S183E, K392D, and K409D; (b) the first light chain comprises the amino acid substitutions G100K and S176K; (c) the second heavy chain comprises amino acid substitutions G44K, S183K, E356K, and D399K; and (d) the second light chain comprises the amino acid substitutions G100E and S176E.

In other embodiments, a heterodimeric antibody of the invention comprises a first heavy chain, a second heavy chain, a first light chain, and a second light chain, wherein the first heavy chain comprises amino acid substitutions at positions 183, 392, and 409 (all positions according to the EU numbering system), wherein the second heavy chain comprises amino acid substitutions at positions 183, 356, and 399 (all positions according to the EU numbering system), wherein the first and second light chains comprise an amino acid substitution at position 176 (position according to the Kabat numbering system), and wherein the amino acid substitutions introduce a charged amino acid at said positions. In such embodiments, the serine at position 176 (according to Kabat numbering) of the first light chain is replaced with lysine; the serine at position 176 (according to Kabat numbering) of the second light chain is replaced with glutamic acid; the serine at position 183 (according to EU numbering) of the first heavy chain is replaced with glutamic acid, the lysine at position 392 (according to EU numbering) of the first heavy chain is replaced with aspartic acid, the lysine at position 409 (according to EU numbering) of the first heavy chain is replaced with aspartic acid; the serine at position 183 (according to EU numbering) of the second heavy chain is replaced with lysine, the glutamic acid at position 356 (according to EU numbering) of the second heavy chain is replaced with lysine, and/or the aspartic acid at position 399 (according to EU numbering) of the second heavy chain is replaced with lysine. Thus, in some embodiments, the heterodimeric antibody comprises a first heavy chain, a first light chain, a second heavy chain, and a second light chain, wherein (a) the first heavy chain comprises amino acid substitutions S183E, K392D, and K409D; (b) the first light chain comprises the amino acid substitution S176K; (c) the second heavy chain comprises amino acid substitutions S183K, E356K, and D399K; and (d) the second light chain comprises the amino acid substitution S176E.

In still other embodiments, a heterodimeric antibody of the invention comprises a first heavy chain, a second heavy chain, a first light chain, and a second light chain, wherein the first heavy chain comprises amino acid substitutions at positions 183, 370, 392, and 409 (all positions according to the EU numbering system), wherein the second heavy chain comprises amino acid substitutions at positions 183, 356, 357, and 399 (all positions according to the EU numbering system), wherein the first and second light chains comprise an amino acid substitution at position 176 (position according to the Kabat numbering system), and wherein the amino acid substitutions introduce a charged amino acid at said positions. In such embodiments, the serine at position 176 (according to Kabat numbering) of the first light chain is replaced with lysine; the serine at position 176 (according to Kabat numbering) of the second light chain is replaced with glutamic acid; the serine at position 183 (according to EU numbering) of the first heavy chain is replaced with glutamic acid, the lysine at position 370 (according to EU numbering) of the first heavy chain is replaced with aspartic acid, the lysine at position 392 (according to EU numbering) of the first heavy chain is replaced with aspartic acid, the lysine at position 409 (according to EU numbering) of the first heavy chain is replaced with aspartic acid; the serine at position 183 (according to EU numbering) of the second heavy chain is replaced with lysine, the glutamic acid at position 356 (according to EU numbering) of the second heavy chain is replaced with lysine, the glutamic acid at position 357 (according to EU numbering) of the second heavy chain is replaced with lysine, and/or the aspartic acid at position 399 (according to EU numbering) of the second heavy chain is replaced with lysine. Accordingly, in some embodiments, the heterodimeric antibody comprises a first heavy chain, a first light chain, a second heavy chain, and a second light chain, wherein (a) the first heavy chain comprises amino acid substitutions S183E, K370D, K392D, and K409D; (b) the first light chain comprises the amino acid substitution S176K; (c) the second heavy chain comprises amino acid substitutions S183K, E356K, E357K, and D399K; and (d) the second light chain comprises the amino acid substitution S176E.

In certain embodiments, a heterodimeric antibody of the invention comprises a first heavy chain, a second heavy chain, a first light chain, and a second light chain, wherein the first heavy chain comprises amino acid substitutions at positions 183, 392, 409, and 439 (all positions according to the EU numbering system), wherein the second heavy chain comprises amino acid substitutions at positions 183, 356, and 399 (all positions according to the EU numbering system), wherein the first and second light chains comprise an amino acid substitution at position 176 (position according to the Kabat numbering system), and wherein the amino acid substitutions introduce a charged amino acid at said positions. In such embodiments, the serine at position 176 (according to Kabat numbering) of the first light chain is replaced with lysine; the serine at position 176 (according to Kabat numbering) of the second light chain is replaced with glutamic acid; the serine at position 183 (according to EU numbering) of the first heavy chain is replaced with glutamic acid, the lysine at position 392 (according to EU numbering) of the first heavy chain is replaced with aspartic acid, the lysine at position 409 (according to EU numbering) of the first heavy chain is replaced with aspartic acid, the lysine at position 439 (according to EU numbering) of the first heavy chain is replaced with aspartic acid; the serine at position 183 (according to EU numbering) of the second heavy chain is replaced with lysine, the glutamic acid at position 356 (according to EU numbering) of the second heavy chain is replaced with lysine, and/or the aspartic acid at position 399 (according to EU numbering) of the second heavy chain is replaced with lysine. Thus, in some embodiments, the heterodimeric antibody comprises a first heavy chain, a first light chain, a second heavy chain, and a second light chain, wherein (a) the first heavy chain comprises amino acid substitutions S183E, K392D, K409D, and K439D; (b) the first light chain comprises the amino acid substitution S176K; (c) the second heavy chain comprises amino acid substitutions S183K, E356K, and D399K; and (d) the second light chain comprises the amino acid substitution S176E.

In some embodiments, a heterodimeric antibody of the invention comprises a first heavy chain, a second heavy chain, a first light chain, and a second light chain, wherein the first heavy chain comprises amino acid substitutions at positions 183, 360, 370, 392, and 409 (all positions according to the EU numbering system), wherein the second heavy chain comprises amino acid substitutions at positions 183, 357, and 399 (all positions according to the EU numbering system), wherein the first and second light chains comprise an amino acid substitution at position 176 (position according to the Kabat numbering system), and wherein the amino acid substitutions introduce a charged amino acid at said positions. In such embodiments, the serine at position 176 (according to Kabat numbering) of the first light chain is replaced with lysine; the serine at position 176 (according to Kabat numbering) of the second light chain is replaced with glutamic acid; the serine at position 183 (according to EU numbering) of the first heavy chain is replaced with glutamic acid, the lysine at position 360 (according to EU numbering) of the first heavy chain is replaced with glutamic acid, the lysine at position 370 (according to EU numbering) of the first heavy chain is replaced with glutamic acid, the lysine at position 392 (according to EU numbering) of the first heavy chain is replaced with glutamic acid, the lysine at position 409 (according to EU numbering) of the first heavy chain is replaced with aspartic acid; the serine at position 183 (according to EU numbering) of the second heavy chain is replaced with lysine, the glutamic acid at position 357 (according to EU numbering) of the second heavy chain is replaced with lysine, and/or the aspartic acid at position 399 (according to EU numbering) of the second heavy chain is replaced with lysine. Accordingly, in some embodiments, the heterodimeric antibody comprises a first heavy chain, a first light chain, a second heavy chain, and a second light chain, wherein (a) the first heavy chain comprises amino acid substitutions S183E, K360E, K370E, K392E, and K409D; (b) the first light chain comprises the amino acid substitution S176K; (c) the second heavy chain comprises amino acid substitutions S183K, E357K, and D399K; and (d) the second light chain comprises the amino acid substitution S176E.

Any of the light chain and heavy chain constant domains, anti-PAC1 receptor variable regions, and anti-CGRP receptor variable regions described herein can be modified to contain one or more of the charge pair mutations described above to facilitate correct assembly of a heterodimeric antibody. Exemplary full-length light chain sequences and full-length heavy chain sequences from anti-CGRP receptor antibodies containing one or more charge pair mutations suitable for use in the heterodimeric antibodies of the invention are shown above in Table 5A and Table 5B, respectively.

In some embodiments, the heterodimeric antibody of the invention comprises an anti-CGRP receptor antibody light chain from Table 5A and an anti-CGRP receptor antibody heavy chain from Table 5B. Exemplary pairs of anti-CGRP receptor antibody light and heavy chains that may be incorporated into a heterodimeric antibody of the invention include, but are not limited to: LC-03 (SEQ ID NO: 71) and HC-02 (SEQ ID NO: 86); LC-04 (SEQ ID NO: 72) and HC-03 (SEQ ID NO: 87); LC-04 (SEQ ID NO: 72) and HC-04 (SEQ ID NO: 88); LC-04 (SEQ ID NO: 72) and HC-05 (SEQ ID NO: 89); LC-04 (SEQ ID NO: 72) and HC-06 (SEQ ID NO: 90); LC-04 (SEQ ID NO: 72) and HC-07 (SEQ ID NO: 91); LC-05 (SEQ ID NO: 73) and HC-02 (SEQ ID NO: 86); LC-06 (SEQ ID NO: 74) and HC-03 (SEQ ID NO: 87); LC-06 (SEQ ID NO: 74) and HC-04 (SEQ ID NO: 88); LC-07 (SEQ ID NO: 75) and HC-08 (SEQ ID NO: 92); LC-08 (SEQ ID NO: 76) and HC-09 (SEQ ID NO: 93); LC-08 (SEQ ID NO: 76) and HC-10 (SEQ ID NO: 94); LC-02 (SEQ ID NO: 70) and HC-08 (SEQ ID NO: 92); LC-09 (SEQ ID NO: 77) and HC-02 (SEQ ID NO: 86); LC-10 (SEQ ID NO: 78) and HC-02 (SEQ ID NO: 86); LC-02 (SEQ ID NO: 70) and HC-11 (SEQ ID NO: 95); LC-11 (SEQ ID NO: 79) and HC-02 (SEQ ID NO: 86); LC-02 (SEQ ID NO: 70) and HC-12 (SEQ ID NO: 96); LC-02 (SEQ ID NO: 70) and HC-13 (SEQ ID NO: 97); LC-12 (SEQ ID NO: 80) and HC-14 (SEQ ID NO: 98); LC-13 (SEQ ID NO: 81) and HC-02 (SEQ ID NO: 86); LC-14 (SEQ ID NO: 82) and HC-02 (SEQ ID NO: 86); LC-15 (SEQ ID NO: 83) and HC-02 (SEQ ID NO: 86); and LC-16 (SEQ ID NO: 84) and HC-02 (SEQ ID NO: 86). In certain embodiments, the heterodimeric antibody of the invention comprises an anti-CGRP receptor antibody light chain comprising the sequence of SEQ ID NO: 72 and an anti-CGRP receptor antibody heavy chain comprising a sequence selected from SEQ ID NOs: 87-91. In other embodiments, the heterodimeric antibody of the invention comprises an anti-CGRP receptor antibody light chain comprising the sequence of SEQ ID NO: 74 and an anti-CGRP receptor antibody heavy chain comprising the sequence of SEQ ID NO: 87 or SEQ ID NO: 88. In still other embodiments, the heterodimeric antibody of the invention comprises an anti-CGRP receptor antibody light chain comprising the sequence of SEQ ID NO: 76 and an anti-CGRP receptor antibody heavy chain comprising the sequence of SEQ ID NO: 93 or SEQ ID NO: 94.

The anti-CGRP receptor antibody light chain and/or heavy chain incorporated into a heterodimeric antibody of the invention may comprise a sequence of contiguous amino acids that differs from the sequence of a light chain in Table 5A or a heavy chain in Table 5B by 1, 2, 3, 4, 5, 6, 7, 8, 9, 10, 11, 12, 13, 14, 15 or more amino acid residues, wherein each such sequence difference is independently a deletion, insertion or substitution of one amino acid. In some embodiments, the anti-CGRP receptor antibody light chain incorporated into a heterodimeric antibody of the invention comprises a sequence of amino acids that has at least 70%, at least 75%, at least 80%, at least 85%, at least 90%, at least 95%, at least 97% or at least 99% sequence identity to the amino acid sequences of SEQ ID NOs: 69-84 (i.e. the anti-CGRP receptor antibody light chains in Table 5A). In one embodiment, a heterodimeric antibody of the invention comprises an anti-CGRP receptor antibody light chain that comprises a sequence that is at least 90% identical to a sequence selected from SEQ ID NOs: 70-84. In another embodiment, a heterodimeric antibody of the invention comprises an anti-CGRP receptor antibody light chain that comprises a sequence that is at least 95% identical to a sequence selected from SEQ ID NOs: 70-84. In certain embodiments, the anti-CGRP receptor antibody heavy chain incorporated into a heterodimeric antibody of the invention comprises a sequence of amino acids that has at least 70%, at least 75%, at least 80%, at least 85%, at least 90%, at least 95%, at least 97% or at least 99% sequence identity to the amino acid sequences of SEQ ID NOs: 85-98 (i.e. the anti-CGRP receptor antibody heavy chains in Table 5B). In one embodiment, a heterodimeric antibody of the invention comprises an anti-CGRP receptor antibody heavy chain that comprises a sequence that is at least 90% identical to a sequence selected from SEQ ID NOs: 86-98. In another embodiment, a heterodimeric antibody of the invention comprises an anti-CGRP receptor antibody heavy chain that comprises a sequence that is at least 95% identical to a sequence selected from SEQ ID NOs: 86-98.

Exemplary full-length light chain sequences and full-length heavy chain sequences from anti-PAC1 receptor antibodies containing one or more charge pair mutations suitable for use in the heterodimeric antibodies of the invention are shown below in Table 7A and Table 7B, respectively.

TABLE 7A

Exemplary Anti-PAC1 Receptor Antibody Light Chain Sequences

| Antibody ID. | LC Group | Light Chain Amino Acid Sequence | Light Chain Nucleic Acid Sequence |
|---|---|---|---|
| 29G4v22 | LC-101 | DIQLTQSPSFLSASVGDRVTIT CRASQSIGRSLHWYQQKPGKA PKLLIKYASQSLSGVPSRFSGS GSGTEFTLTISSLQPEDFATYY CHQSSRLPFTFGPGTKVDIKRT VAAPSVFIFPPSDEQLKSGTAS VVCLLNNFYPREAKVQWKVD NALQSGNSQESVTEQDSKDST YSLSSTLTLSKADYEKHKVYA CEVTHQGLSSPVTKSFNRGEC (SEQIDNO: 231) | GATATCCAGCTCACTCAATCGCCATCATTTCTCTC CGCTTCGGTAGGCGACCGGGTCACGATCACATGC AGGGCGTCGCAAAGCATTGGGAGGTCGTTGCATT GGTATCAGCAGAAACCCGGAAAGGCCCCGAAACT TCTGATCAAATACGCATCACAAAGCTTGAGCGGT GTGCCGTCGCGCTTCTCCGGTTCCGGAAGCGGAA CGGAATTCACGCTTACAATCTCCTCACTGCAGCCC GAGGATTTCGCGACCTATTACTGTCACCAGTCATC CAGACTCCCGTTTACTTTTGGCCCTGGGACCAAGG TGGACATTAAGCGTACGGTGGCTGCACCATCTGT CTTCATCTTCCCGCCATCTGATGAGCAGTTGAAAT CTGGAACTGCCTCTGTTGTGTGCCTGCTGAATAAC TTCTATCCCAGAGAGGCCAAAGTACAGTGGAAGG TGGATAACGCCCTCCAATCGGGTAACTCCCAGGA GAGTGTCACAGAGCAGGACAGCAAGGACAGCAC CTACAGCCTCAGCAGCACCCTGACGCTGAGCAAA GCAGACTACGAGAAACACAAAGTCTACGCCTGCG AAGTCACCCATCAGGGCCTGAGCTCGCCCGTCAC AAAGAGCTTCAACAGGGGAGAGTGT (SEQ ID NO: 312) |
| 101A, 101B, 101C, 101D, 101E, 101F, 101G, 102A, 102B, 102C, 102D, 123A, 123B, 124A, 124B, 125A, 125B, 126A, 126B, 127A, 127B, 131A, 131B, 132A, 132B | LC-102 | EIVLTQSPATLSLSPGERATLS CRASKSVGRSLHWYQQKPGQ APRLLIKYASQSLSGIPARFSGS GSGTDFTLTISSLEPEDFAVYY CHQSSRLPFTFGPGTKVDIKRT VAAPSVFIFPPSDEQLKSGTAS VVCLLNNFYPREAKVQWKVD NALQSGNSQESVTEQDSKDST YSLESTLTLSKADYEKHKVYA CEVTHQGLSSPVTKSFNRGEC (SEQ ID NO: 232) | GAGATCGTACTTACTCAGTCACCCGCCACATTGTC CCTGAGCCCGGGTGAACGGGCGACCCTCAGCTGC CGAGCATCCAAGTCCGTCGGACGATCATTGCACT GGTACCAACAAAAACCGGGCCAGGCCCCCAGACT TCTGATCAAGTATGCGTCACAGAGCTTGTCGGGT ATTCCCGCTCGCTTTTCGGGGTCGGGATCCGGGAC AGATTTCACGCTCACAATCTCCTCGCTGGAACCCG AGGACTTCGCGGTCTACTATTGTCATCAGTCATCG AGGTTGCCTTTCACGTTTGGACCAGGGACCAAGG TGGACATTAAGCGTACGGTGGCTGCACCATCTGT CTTCATCTTCCCGCCATCTGATGAGCAGTTGAAAT CTGGAACTGCCTCTGTTGTGTGCCTGCTGAATAAC TTCTATCCCAGAGAGGCCAAAGTACAGTGGAAGG TGGATAACGCCCTCCAATCGGGTAACTCCCAGGA GAGTGTCACAGAGCAGGACAGCAAGGACAGCAC CTACAGCCTCGAAAGCACCCTGACGCTGAGCAAA GCAGACTACGAGAAACACAAAGTCTACGCCTGCG AAGTCACCCATCAGGGCCTGAGCTCGCCCGTCAC AAAGAGCTTCAACAGGGGAGAGTGT (SEQ ID NO: 313) |
| 103A, 103B, 104A, 104B, 105A, 105B, 106A, 106B, 107A, 107B, 109A, 109B, 110A, 110B, | LC-103 | EIVLTQSPATLSLSPGERATLS CRASKSVGWSLHWYQQKPGQ APRLLIKYASQSLSGIPARFSGS GSGTDFTLTISSLEPEDFAVYY CHQSSRLPFTFGPGTKVDIKRT VAAPSVFIFPPSDEQLKSGTAS VVCLLNNFYPREAKVQWKVD | GAGATCGTACTTACTCAGTCACCCGCCACATTGTC CCTGAGCCCGGGTGAACGGGCGACCCTCAGCTGC CGAGCATCCAAATCCGTCGGGTGGAGCTTGCACT GGTACCAACAAAAACCGGGCCAGGCCCCCAGACT TCTGATCAAGTATGCGTCACAGAGCTTGTCGGGT ATTCCCGCTCGCTTTTCGGGGTCGGGATCCGGGAC AGATTTCACGCTCACAATCTCCTCGCTGGAACCCG |

TABLE 7A-continued

Exemplary Anti-PAC1 Receptor Antibody Light Chain Sequences

| Antibody ID. | LC Group | Light Chain Amino Acid Sequence | Light Chain Nucleic Acid Sequence |
|---|---|---|---|
| 111A, 111B, 116A, 116B | | NALQSGNSQESVTEQDSKDST YSLESTLTLSKADYEKHKVYA CEVTHQGLSSPVTKSFNRGEC (SEQ ID NO: 233) | AGGACTTCGCGGTCTACTATTGTCATCAGTCATCG AGGTTGCCTTTCACGTTTGGACCAGGGACCAAGG TGGACATTAAGCGTACGGTGGCTGCACCATCTGT CTTCATCTTCCCGCCATCTGATGAGCAGTTGAAAT CTGGAACTGCCTCTGTTGTGTGCCTGCTGAATAAC TTCTATCCCAGAGAGGCCAAAGTACAGTGGAAGG TGGATAACGCCCTCCAATCGGGTAACTCCCAGGA GAGTGTCACAGAGCAGGACAGCAAGGACAGCAC CTACAGCCTCGAAAGCACCCTGACGCTGAGCAAA GCAGACTACGAGAAACACAAAGTCTACGCCTGCG AAGTCACCCATCAGGGCCTGAGCTCGCCCGTCAC AAAGAGCTTCAACAGGGGAGAGTGT (SEQ ID NO: 314) |
| 108A, 108B | LC-104 | EIVLTQSPATLSLSPGERATLS CRASKSVGYSLHWYQQKPGQ APRLLIKYASQSLSGIPARFSGS GSGTDFTLTISSLEPEDFAVYY CHQSSRLPFTFGPGTKVDIKRT VAAPSVFIFPPSDEQLKSGTAS VVCLLNNFYPREAKVQWKVD NALQSGNSQESVTEQDSKDST YSLESTLTLSKADYEKHKVYA CEVTHQGLSSPVTKSFNRGEC (SEQ ID NO: 234) | GAGATCGTACTTACTCAGTCACCCGCCACATTGTC CCTGAGCCCGGGTGAACGGGCGACCCTCAGCTGC CGAGCATCCAAATCCGTCGGGTACAGCTTGCACT GGTACCAACAAAAACCGGGCCAGGCCCCCAGACT TCTGATCAAGTATGCGTCACAGAGCTTGTCGGGT ATTCCCGCTCGCTTTTCGGGGTCGGGATCCGGGAC AGATTTCACGCTCACAATCTCCTCGCTGGAACCCG AGGACTTCGCGGTCTACTATTGTCATCAGTCATCG AGGTTGCCTTTCACGTTTGGACCAGGGACCAAGG TGGACATTAAGCGTACGGTGGCTGCACCATCTGT CTTCATCTTCCCGCCATCTGATGAGCAGTTGAAAT CTGGAACTGCCTCTGTTGTGTGCCTGCTGAATAAC TTCTATCCCAGAGAGGCCAAAGTACAGTGGAAGG TGGATAACGCCCTCCAATCGGGTAACTCCCAGGA GAGTGTCACAGAGCAGGACAGCAAGGACAGCAC CTACAGCCTCGAAAGCACCCTGACGCTGAGCAAA GCAGACTACGAGAAACACAAAGTCTACGCCTGCG AAGTCACCCATCAGGGCCTGAGCTCGCCCGTCAC AAAGAGCTTCAACAGGGGAGAGTGT (SEQ ID NO: 315) |
| 112A, 112B | LC-105 | EIVLTQSPATLSLSPGERATLS CRASKAVGWSLHWYQQKPG QAPRLLIKYASQSLSGIPARFS GSGSGTDFTLTISSLEPEDFAV YYCHQSSRLPFTFGPGTKVDIK RTVAAPSVFIFPPSDEQLKSGT ASVVCLLNNFYPREAKVQWK VDNALQSGNSQESVTEQDSKD STYSLESTLTLSKADYEKHKV YACEVTHQGLSSPVTKSFNRG EC (SEQ ID NO: 235) | GAGATCGTACTTACTCAGTCACCCGCCACATTGTC CCTGAGCCCGGGTGAACGGGCGACCCTCAGCTGC CGAGCATCCAAAGCCGTCGGGTGGAGCTTGCACT GGTACCAACAAAAACCGGGCCAGGCCCCCAGACT TCTGATCAAGTATGCGTCACAGAGCTTGTCGGGT ATTCCCGCTCGCTTTTCGGGGTCGGGATCCGGGAC AGATTTCACGCTCACAATCTCCTCGCTGGAACCCG AGGACTTCGCGGTCTACTATTGTCATCAGTCATCG AGGTTGCCTTTCACGTTTGGACCAGGGACCAAGG TGGACATTAAGCGTACGGTGGCTGCACCATCTGT CTTCATCTTCCCGCCATCTGATGAGCAGTTGAAAT CTGGAACTGCCTCTGTTGTGTGCCTGCTGAATAAC TTCTATCCCAGAGAGGCCAAAGTACAGTGGAAGG TGGATAACGCCCTCCAATCGGGTAACTCCCAGGA GAGTGTCACAGAGCAGGACAGCAAGGACAGCAC CTACAGCCTCGAAAGCACCCTGACGCTGAGCAAA GCAGACTACGAGAAACACAAAGTCTACGCCTGCG AAGTCACCCATCAGGGCCTGAGCTCGCCCGTCAC AAAGAGCTTCAACAGGGGAGAGTGT (SEQ ID NO: 316) |
| 113A, 113B, 114A, 114B, 117A, 117B, 118A, 118B, 119A, 119B | LC-106 | EIVLTQSPATLSLSPGERATLS CRASKSVGQSLHWYQQKPGQ APRLLIKYASQSLSGIPARFSGS GSGTDFTLTISSLEPEDFAVYY CHQSSRLPFTFGPGTKVDIKRT VAAPSVFIFPPSDEQLKSGTAS VVCLLNNFYPREAKVQWKVD NALQSGNSQESVTEQDSKDST YSLESTLTLSKADYEKHKVYA CEVTHQGLSSPVTKSFNRGEC (SEQ ID NO: 236) | GAGATCGTACTTACTCAGTCACCCGCCACATTGTC CCTGAGCCCGGGTGAACGGGCGACCCTCAGCTGC CGAGCATCCAAATCAGTCGGTCAGTCTTTGCACT GGTACCAACAAAAACCGGGCCAGGCCCCCAGACT TCTGATCAAGTATGCGTCACAGAGCTTGTCGGGT ATTCCCGCTCGCTTTTCGGGGTCGGGATCCGGGAC AGATTTCACGCTCACAATCTCCTCGCTGGAACCCG AGGACTTCGCGGTCTACTATTGTCATCAGTCATCG CGTTTGCCTTTCACGTTTGGACCAGGGACCAAGGT GGACATTAAGCGTACGGTGGCTGCACCATCTGTC TTCATCTTCCCGCCATCTGATGAGCAGTTGAAATC TGGAACTGCCTCTGTTGTGTGCCTGCTGAATAACT TCTATCCCAGAGAGGCCAAAGTACAGTGGAAGGT GGATAACGCCCTCCAATCGGGTAACTCCCAGGAG AGTGTCACAGAGCAGGACAGCAAGGACAGCACC TACAGCCTCGAAAGCACCCTGACGCTGAGCAAAG |

TABLE 7A-continued

| Exemplary Anti-PAC1 Receptor Antibody Light Chain Sequences | | | |
|---|---|---|---|
| Antibody ID. | LC Group | Light Chain Amino Acid Sequence | Light Chain Nucleic Acid Sequence |
| | | | CAGACTACGAGAAACACAAAGTCTACGCCTGCGA AGTCACCCATCAGGGCCTGAGCTCGCCCGTCACA AAGAGCTTCAACAGGGGAGAGTGT (SEQ ID NO: 317) |
| 115A, 115B | LC-107 | EIVLTQSPATLSLSPGERATLS CRASRSVGLALHWYQQKPGQ APRLLIKYASQSLSGIPARFSGS GSGTDFTLTISSLEPEDFAVYY CHQSSFLPFTFGPGTKVDIKRT VAAPSVFIFPPSDEQLKSGTAS VVCLLNNFYPREAKVQWKVD NALQSGNSQESVTEQDSKDST YSLESTLTLSKADYEKHKVYA CEVTHQGLSSPVTKSFNRGEC (SEQ ID NO: 237) | GAGATCGTACTTACTCAGTCACCCGCCACATTGTC CCTGAGCCCGGGTGAACGGGCGACCCTCAGCTGC CGAGCATCCCGTTCAGTCGGTCTGGCTTTGCACTG GTACCAACAAAAACCGGGCCAGGCCCCCAGACTT CTGATCAAGTATGCGTCACAGAGCTTGTCGGGTA TTCCCGCTCGCTTTTCGGGGTCGGGATCCGGGACA GATTTCACGCTCACAATCTCCTCGCTGGAACCCGA GGACTTCGCGGTCTACTATTGTCATCAGTCATCGT TCTTGCCTTTCACGTTTGGACCAGGGACCAAGGTG GACATTAAGCGTACGGTGGCTGCACCATCTGTCTT CATCTTCCCGCCATCTGATGAGCAGTTGAAATCTG GAACTGCCTCTGTTGTGTGCCTGCTGAATAACTTC TATCCCAGAGAGGCCAAAGTACAGTGGAAGGTGG ATAACGCCCTCCAATCGGGTAACTCCCAGGAGAG TGTCACAGAGCAGGACAGCAAGGACAGCACCTAC AGCCTCGAAAGCACCCTGACGCTGAGCAAAGCAG ACTACGAGAAACACAAAGTCTACGCCTGCGAAGT CACCCATCAGGGCCTGAGCTCGCCCGTCACAAAG AGCTTCAACAGGGGAGAGTGT (SEQ ID NO: 318) |
| 120A, 120B | LC-108 | EIVLTQSPATLSLSPGERATLS CRASKAVGFSLHWYQQKPGQ APRLLIKYASQSLSGIPARFSGS GSGTDFTLTISSLEPEDFAVYY CHQSSFLPFTFGPGTKVDIKRT VAAPSVFIFPPSDEQLKSGTAS VVCLLNNFYPREAKVQWKVD NALQSGNSQESVTEQDSKDST YSLESTLTLSKADYEKHKVYA CEVTHQGLSSPVTKSFNRGEC (SEQ ID NO: 238) | GAGATCGTACTTACTCAGTCACCCGCCACATTGTC CCTGAGCCCGGGTGAACGGGCGACCCTCAGCTGC CGAGCATCCAAAGCAGTCGGTTTCTCTTTGCACTG GTACCAACAAAAACCGGGCCAGGCCCCCAGACTT CTGATCAAGTATGCGTCACAGAGCTTGTCGGGTA TTCCCGCTCGCTTTTCGGGGTCGGGATCCGGGACA GATTTCACGCTCACAATCTCCTCGCTGGAACCCGA GGACTTCGCGGTCTACTATTGTCATCAGTCATCGT TCTTGCCTTTCACGTTTGGACCAGGGACCAAGGTG GACATTAAGCGTACGGTGGCTGCACCATCTGTCTT CATCTTCCCGCCATCTGATGAGCAGTTGAAATCTG GAACTGCCTCTGTTGTGTGCCTGCTGAATAACTTC TATCCCAGAGAGGCCAAAGTACAGTGGAAGGTGG ATAACGCCCTCCAATCGGGTAACTCCCAGGAGAG TGTCACAGAGCAGGACAGCAAGGACAGCACCTAC AGCCTCGAAAGCACCCTGACGCTGAGCAAAGCAG ACTACGAGAAACACAAAGTCTACGCCTGCGAAGT CACCCATCAGGGCCTGAGCTCGCCCGTCACAAAG AGCTTCAACAGGGGAGAGTGT (SEQ ID NO: 319) |
| 121A, 121B | LC-109 | EIVLTQSPATLSLSPGERATLS CRASRAVSNLHWYQQKPGQA PRLLIKYASQSLSGIPARFSGSG SGTDFTLTISSLEPEDFAVYYC HQS SYLPFTFGPGTKVDIKRTV AAPSVFIFPPSDEQLKSGTASV VCLLNNFYPREAKVQWKVDN ALQSGNSQESVTEQDSKDSTY SLESTLTLSKADYEKHKVYAC EVTHQGLSSPVTKSFNRGEC (SEQ ID NO: 239) | GAGATCGTACTTACTCAGTCACCCGCCACATTGTC CCTGAGCCCGGGTGAACGGGCGACCCTCAGCTGC CGAGCATCCCGTGCAGTCTCTAACTTGCACTGGTA CCAACAAAAACCGGGCCAGGCCCCCAGACTTCTG ATCAAGTATGCGTCACAGAGCTTGTCGGGTATTC CCGCTCGCTTTTCGGGGTCGGGATCCGGGACAGA TTTCACGCTCACAATCTCCTCGCTGGAACCCGAGG ACTTCGCGGTCTACTATTGTCATCAGTCATCGTAC TTGCCTTTCACGTTTGGACCAGGGACCAAGGTGG ACATTAAGCGTACGGTGGCTGCACCATCTGTCTTC ATCTTCCCGCCATCTGATGAGCAGTTGAAATCTGG AACTGCCTCTGTTGTGTGCCTGCTGAATAACTTCT ATCCCAGAGAGGCCAAAGTACAGTGGAAGGTGG ATAACGCCCTCCAATCGGGTAACTCCCAGGAGAG TGTCACAGAGCAGGACAGCAAGGACAGCACCTAC AGCCTCGAAAGCACCCTGACGCTGAGCAAAGCAG ACTACGAGAAACACAAAGTCTACGCCTGCGAAGT CACCCATCAGGGCCTGAGCTCGCCCGTCACAAAG AGCTTCAACAGGGGAGAGTGT (SEQ ID NO: 320) |

TABLE 7A-continued

Exemplary Anti-PAC1 Receptor Antibody Light Chain Sequences

| Antibody ID. | LC Group | Light Chain Amino Acid Sequence | Light Chain Nucleic Acid Sequence |
|---|---|---|---|
| 122A, 122B | LC-110 | EIVLTQSPATLSLSPGERATLS CRASKAVWHNLHWYQQKPG QAPRLLIKYASQSLSGIPARFS GSGSGTDFTLTISSLEPEDFAV YYCHQSSMLPFTFGPGTKVDI KRTVAAPSVFIFPPSDEQLKSG TASVVCLLNNFYPREAKVQW KVDNALQSGNSQESVTEQDSK DSTYSLESTLTLSKADYEKHK VYACEVTHQGLSSPVTKSFNR GEC (SEQ ID NO: 240) | GAGATCGTACTTACTCAGTCACCCGCCACATTGTC CCTGAGCCCGGGTGAACGGGCGACCCTCAGCTGC CGAGCATCCAAAGCAGTCTGGCATAACTTGCACT GGTACCAACAAAAACCGGGCCAGGCCCCCAGACT TCTGATCAAGTATGCGTCACAGAGCTTGTCGGGT ATTCCCGCTCGCTTTTCGGGGTCGGGATCCGGGAC AGATTTCACGCTCACAATCTCCTCGCTGGAACCCG AGGACTTCGCGGTCTACTATTGTCATCAGTCATCG ATGTTGCCTTTCACGTTTGGACCAGGGACCAAGG TGGACATTAAGCGTACGGTGGCTGCACCATCTGT CTTCATCTTCCCGCCATCTGATGAGCAGTTGAAAT CTGGAACTGCCTCTGTTGTGTGCCTGCTGAATAAC TTCTATCCCAGAGAGGCCAAAGTACAGTGGAAGG TGGATAACGCCCTCCAATCGGGTAACTCCCAGGA GAGTGTCACAGAGCAGGACAGCAAGGACAGCAC CTACAGCCTCGAAAGCACCCTGACGCTGAGCAAA GCAGACTACGAGAAACACAAAGTCTACGCCTGCG AAGTCACCCATCAGGGCCTGAGCTCGCCCGTCAC AAAGAGCTTCAACAGGGGAGAGTGT (SEQ ID NO: 321) |
| 128A, 128B, 129A, 129B, 130A, 130B | LC-111 | EIVLTQSPATLSLSPGERATLS CRASQSVGRSLHWYQQKPGQ APRLLIKYASQSLSGIPARFSGS GSGTDFTLTISSLEPEDFAVYY CHQSSRLPFTFGPGTKVDIKRT VAAPSVFIFPPSDEQLKSGTAS VVCLLNNFYPREAKVQWKVD NALQSGNSQESVTEQDSKDST YSLESTLTLSKADYEKHKVYA CEVTHQGLSSPVTKSFNRGEC (SEQ ID NO: 241) | GAGATCGTACTTACTCAGTCACCCGCCACATTGTC CCTGAGCCCGGGTGAACGGGCGACCCTCAGCTGC CGAGCATCCCAGTCCGTCGGACGATCATTGCACT GGTACCAACAAAAACCGGGCCAGGCCCCCAGACT TCTGATCAAGTATGCGTCACAGAGCTTGTCGGGT ATTCCCGCTCGCTTTTCGGGGTCGGGATCCGGGAC AGATTTCACGCTCACAATCTCCTCGCTGGAACCCG AGGACTTCGCGGTCTACTATTGTCATCAGTCATCG AGGTTGCCTTTCACGTTTGGACCAGGGACCAAGG TGGACATTAAGCGTACGGTGGCTGCACCATCTGT CTTCATCTTCCCGCCATCTGATGAGCAGTTGAAAT CTGGAACTGCCTCTGTTGTGTGCCTGCTGAATAAC TTCTATCCCAGAGAGGCCAAAGTACAGTGGAAGG TGGATAACGCCCTCCAATCGGGTAACTCCCAGGA GAGTGTCACAGAGCAGGACAGCAAGGACAGCAC CTACAGCCTCGAAAGCACCCTGACGCTGAGCAAA GCAGACTACGAGAAACACAAAGTCTACGCCTGCG AAGTCACCCATCAGGGCCTGAGCTCGCCCGTCAC AAAGAGCTTCAACAGGGGAGAGTGT (SEQ ID NO: 322) |

TABLE 7B

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| 29G4v22 | HC-101 | QVQLVESGAEVVKPGASVKV SCKASGFTFSRFAMHWVRQA PGQGLEWMGVISYDGGNKYY AESVKGRVTMTRDTSTSTLY MELSSLRSEDTAVYYCARGY DVLTGYPDYWGQGTLVTVSS ASTKGPSVFPLAPSSKSTSGGT AALGCLVKDYFPEPVTVSWNS GALTSGVHTFPAVLQSSGLYS LSSVVTVPSSSLGTQTYICNVN HKPSNTKVDKKVEPKSCDKT HTCPPCPAPELLGGPSVFLFPP KPKDTLMISRTPEVTCVVVDV SHEDPEVKFNWYVDGVEVHN AKTKPREEQYGSTYRVVSVLT VLHQDWLNGKEYKCKVSNK ALPAPIEKTISKAKGQPREPQV YTLPPSREEMTKNQVSLTCLV KGFYPSDIAVEWESNGQPENN | CAAGTTCAGTTGGTGGAGTCTGGAGCCGAAGTAGTA AAGCCAGGAGCTTCAGTGAAAGTCTCTTGTAAAGCA AGTGGATTCACGTTTAGCCGCTTTGCCATGCATTGGG TGCGGCAAGCTCCCGGTCAGGGGTTGGAGTGGATGG GAGTTATTAGCTATGACGGGGGCAATAAGTACTACG CCGAGTCTGTTAAGGGTCGGGTCACAATGACACGGG ACACCTCAACCAGTACACTCTATATGGAACTGTCTA GCCTGAGATCCGAGGACACCGCTGTGTATTATTGCG CTAGGGGGTACGATGTATTGACGGGTTATCCTGATT ACTGGGGGCAGGGGACACTCGTAACCGTCTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAGCAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC |

TABLE 7B-continued

| Exemplary Anti-PAC1 Receptor Antibody Heavy Chain Sequences | | | |
|---|---|---|---|
| Antibody ID. | HC Group | Heavy Chain Amino Acid Sequence | Heavy Chain Nucleic Acid Sequence |
| | | YKTTPPVLDSDGSFFLYSKLTV DKSRWQQGNVFSCSVMHEAL HNHYTQKSLSLSPGK (SEQ ID NO: 242) | CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGCGGGAGGAGCAGTACGGCAGC ACGTACCGTGTGGTCAGCGTCCTCACCGTCCTGCACC AGGACTGGCTGAATGGCAAGGAGTACAAGTGCAAG GTCTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACAAGACCAC GCCTCCCGTGCTGGACTCCGACGGCTCCTTCTTCCTC TATAGCAAGCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 323) |
| 101A | HC-102 | QVQLVESGGGVVQPGRSLRLS CAASGFTFSRFAMHWVRQAP GKGLEWVAVISYQGRNKYYA ESVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 243) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CAGTTATCTCATATCAGGGACGCAATAAATACTATG CAGAGTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 324) |
| 101B | HC-103 | QVQLVESGGGVVQPGRSLRLS CAASGFTFSRFAMHWVRQAP GKGLEWVAVISYQGRNKYYA ESVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CAGTTATCTCATATCAGGGACGCAATAAATACTATG CAGAGTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | PIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK (SEQ ID NO: 244) | GCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCGATGGCTTCTATCCCAGCGACATCGCCGTGGAGTGGGAGAGCAATGGGCAGCCGGAGAACAACTACGACACCACGCCTCCCGTGCTGGACTCCGACGGCTCCTTCTTCCTCTATAGCGACCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 325) |
| 101C | HC-104 | QVQLVESGGGVVQPGRSLRLSCAASGFTFSRFAMHWVRQAPGKGLEWVAVISYQGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGK (SEQ ID NO: 245) | CAGGTGCAGCTGGTGGAGTCTGGGGGAGGCGTGGTCCAGCCTGGGAGGTCCCTGCGACTCTCCTGTGCAGCCTCTGGATTCACCTTCAGTAGATTTGCCATGCACTGGGTCCGCCAGGCTCCAGGCAAGGGGCTGGAGTGGGTGGCAGTTATCTCATATCAGGGACGCAATAAATACTATGCAGAGTCCGTGAAGGGCCGGTTCACCATCTCCAGAGACAATTCCAAGAACACCCTGTATCTGCAAATGAACAGCCTGAGAGCTGAGGACACGGCTCTGTTTTACTGTGCGAGAGGATACGATGTTTTGACTGGTTACCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAAGAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACGACACCACGCCTCCCGTGCTGGACTCCGACGGCTCCTTCTTCCTCTATAGCGACCTCACCGTGGACAAGAGCAGGTGGCAGCAGGGGAACGTCTTCTCATGCTCCGTGATGCATGAGGCTCTGCACAACCACTACACGCAGGACAGCCTCTCCCTGTCTCCGGGCAAA (SEQ ID NO: 326) |
| 101D | HC-105 | QVQLVESGGGVVQPGRSLRLSCAASGFTFSRFAMHWVRQAPGKGLEWVAVISYQGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHE | CAGGTGCAGCTGGTGGAGTCTGGGGGAGGCGTGGTCCAGCCTGGGAGGTCCCTGCGACTCTCCTGTGCAGCCTCTGGATTCACCTTCAGTAGATTTGCCATGCACTGGGTCCGCCAGGCTCCAGGCAAGGGGCTGGAGTGGGTGGCAGTTATCTCATATCAGGGACGCAATAAATACTATGCAGAGTCCGTGAAGGGCCGGTTCACCATCTCCAGAGACAATTCCAAGAACACCCTGTATCTGCAAATGAACAGCCTGAGAGCTGAGGACACGGCTCTGTTTTACTGTGCGAGAGGATACGATGTTTTGACTGGTTACCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCG |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTENQVSLTCLVEGFY<br>PSDIAVEWESNGQPENNYETT<br>PPVLDSDGSFFLYSDLTVDKSR<br>WQQGNVFSCSVMHEALHNHY<br>TQKSLSLSPGK (SEQ ID NO:<br>246) | GTGACGGTGTCGTGGAACTCAGGCGCCCTGACCAGC<br>GGCGTGCACACCTTCCCGGCTGTCCTACAGTCCTCAG<br>GACTCTACTCCCTCAAGAGCGTGGTGACCGTGCCCT<br>CCAGCAGCTTGGGCACCCAGACCTACATCTGCAACG<br>TGAATCACAAGCCCAGCAACACCAAGGTGGACAAG<br>AAAGTTGAGCCCAAATCTTGTGACAAAACTCACACA<br>TGCCCACCGTGCCCAGCACCTGAACTCCTGGGGGGA<br>CCGTCAGTCTTCCTCTTCCCCCCAAAACCCAAGGACA<br>CCCTCATGATCTCCCGGACCCCTGAGGTCACATGCGT<br>GGTGGTGGACGTGAGCCACGAAGACCCTGAGGTCAA<br>GTTCAACTGGTACGTGGACGGCGTGGAGGTGCATAA<br>TGCCAAGACAAAGCCGTGCGAGGAGCAGTACGGCA<br>GCACGTACCGTTGCGTCAGCGTCCTCACCGTCCTGCA<br>CCAGGACTGGCTGAATGGCAAGGAGTACAAGTGCA<br>AGGTGTCCAACAAAGCCCTCCCAGCCCCCATCGAGA<br>AAACCATCTCCAAAGCCAAAGGGCAGCCCCGAGAA<br>CCACAGGTGTACACCCTGCCCCCATCCCGGGAGGAG<br>ATGACCGAGAACCAGGTCAGCCTGACCTGCCTGGTC<br>GAGGGCTTCTATCCCAGCGACATCGCCGTGGAGTGG<br>GAGAGCAATGGGCAGCCGGAGAACAACTACGAGAC<br>CACGCCTCCCGTGCTGGACTCCGACGGCTCCTTCTTC<br>CTCTATAGCGACCTCACCGTGGACAAGAGCAGGTGG<br>CAGCAGGGGAACGTCTTCTCATGCTCCGTGATGCAT<br>GAGGCTCTGCACAACCACTACACGCAGAAGAGCCTC<br>TCCCTGTCTCCGGGCAAA (SEQ ID NO: 327) |
| 101E | HC-106 | QVQLVESGGGVVQPGRSLRLS<br>CAASGFTFSRFAMHWVRQAP<br>GKGLEWVAVISYQGRNKYYA<br>ESVKGRFTISRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLYITREPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVKGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>247) | CAGGTGCAGCTGGTGGAGTCTGGGGGAGGCGTGG<br>TCCAGCCTGGGAGGTCCCTGCGACTCTCCTGTGCAG<br>CCTCTGGATTCACCTTCAGTAGATTTGCCATGCACTG<br>GGTCCGCCAGGCTCCAGGCAAGGGGCTGGAGTGGGT<br>GGCAGTTATCTCATATCAGGGACGCAATAAATACTA<br>TGCAGAGTCCGTGAAGGGCCGGTTCACCATCTCCAG<br>AGACAATTCCAAGAACACCCTGTATCTGCAAATGAA<br>CAGCCTGAGAGCTGAGGACACGGCTCTGTTTTACTG<br>TGCGAGAGGATACGATGTTTTGACTGGTTACCCCGA<br>CTACTGGGGCCAGGGAACCCTGGTCACCGTGTCTAG<br>TGCCTCCACCAAGGGCCCATCGGTCTTCCCCCTGGCA<br>CCCTCCTCCAAGAGCACCTCTGGGGGCACAGCGGCC<br>CTGGGCTGCCTGGTCAAGGACTACTTCCCCGAACCG<br>GTGACGGTGTCGTGGAACTCAGGCGCCCTGACCAGC<br>GGCGTGCACACCTTCCCGGCTGTCCTACAGTCCTCAG<br>GACTCTACTCCCTCAAGAGCGTGGTGACCGTGCCCT<br>CCAGCAGCTTGGGCACCCAGACCTACATCTGCAACG<br>TGAATCACAAGCCCAGCAACACCAAGGTGGACAAG<br>AAAGTTGAGCCCAAATCTTGTGACAAAACTCACACA<br>TGCCCACCGTGCCCAGCACCTGAACTCCTGGGGGGA<br>CCGTCAGTCTTCCTCTTCCCCCCAAAACCCAAGGACA<br>CCCTCTATATCACCCGGGAGCCTGAGGTCACATGCG<br>TGGTGGTGGACGTGAGCCACGAAGACCCTGAGGTCA<br>AGTTCAACTGGTACGTGGACGGCGTGGAGGTGCATA<br>ATGCCAAGACAAAGCCGTGCGAGGAGCAGTACGGC<br>AGCACGTACCGTTGCGTCAGCGTCCTCACCGTCCTGC<br>ACCAGGACTGGCTGAATGGCAAGGAGTACAAGTGC<br>AAGGTGTCCAACAAAGCCCTCCCAGCCCCCATCGAG<br>AAAACCATCTCCAAAGCCAAAGGGCAGCCCCGAGA<br>ACCACAGGTGTACACCCTGCCCCCATCCCGGGAGGA<br>GATGACCAAGAACCAGGTCAGCCTGACCTGCCTGGT<br>CAAAGGCTTCTATCCCAGCGACATCGCCGTGGAGTG<br>GGAGAGCAATGGGCAGCCGGAGAACAACTACGACA<br>CCACGCCTCCCGTGCTGGACTCCGACGGCTCCTTCTT<br>CCTCTATAGCGACCTCACCGTGGACAAGAGCAGGTG<br>GCAGCAGGGGAACGTCTTCTCATGCTCCGTGATGCA<br>TGAGGCTCTGCACAACCACTACACGCAGAAGAGCCT<br>CTCCCTGTCTCCGGGCAAA (SEQ ID NO: 328) |
| 101F | HC-107 | QVQLVESGGGVVQPGRSLRLS<br>CAASGFTFSRFAMHWVRQAP<br>GKGLEWVAVISYQGRNKYYA<br>ESVKGRFTISRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK | CAGGTGCAGCTGGTGGAGTCTGGGGGAGGCGTGG<br>TCCAGCCTGGGAGGTCCCTGCGACTCTCCTGTGCAG<br>CCTCTGGATTCACCTTCAGTAGATTTGCCATGCACTG<br>GGTCCGCCAGGCTCCAGGCAAGGGGCTGGAGTGGGT<br>GGCAGTTATCTCATATCAGGGACGCAATAAATACTA<br>TGCAGAGTCCGTGAAGGGCCGGTTCACCATCTCCAG<br>AGACAATTCCAAGAACACCCTGTATCTGCAAATGAA<br>CAGCCTGAGAGCTGAGGACACGGCTCTGTTTTACTG<br>TGCGAGAGGATACGATGTTTTGACTGGTTACCCCGA<br>CTACTGGGGCCAGGGAACCCTGGTCACCGTGTCTAG |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | PSNTKVDKKVEPKSCDKTHTC | TGCCTCCACCAAGGGCCCATCGGTCTTCCCCCTGGCA |
| | | PPCPAPELLGGPSVFLFPPKPK | CCCTCCTCCAAGAGCACCTCTGGGGGCACAGCGGCC |
| | | DTLYITREPEVTCVVVDVSHE | CTGGGCTGCCTGGTCAAGGACTACTTCCCCGAACCG |
| | | DPEVKFNWYVDGVEVHNAKT | GTGACGGTGTCGTGGAACTCAGGCGCCCTGACCAGC |
| | | KPCEEQYGSTYRCVSVLTVLH | GGCGTGCACACCTTCCCGGCTGTCCTACAGTCCTCAG |
| | | QDWLNGKEYKCKVSNKALPA | GACTCTACTCCCTCAAGAGCGTGGTGACCGTGCCCT |
| | | PIEKTISKAKGQPREPQVYTLP | CCAGCAGCTTGGGCACCCAGACCTACATCTGCAACG |
| | | PSREEMTKNQVSLTCLVKGFY | TGAATCACAAGCCCAGCAACACCAAGGTGGACAAG |
| | | PSDIAVEWESNGQPENNYDTT | AAAGTTGAGCCCAAATCTTGTGACAAAACTCACACA |
| | | PPVLDSDGSFFLYSDLTVDKSR | TGCCCACCGTGCCCAGCACCTGAACTCCTGGGGGGA |
| | | WQQGNVFSCSVMHEALHNHY | CCGTCAGTCTTCCTCTTCCCCCCAAAACCCAAGGACA |
| | | TQDSLSLSPGK (SEQ ID NO: | CCCTCTATATCACCCGGGAGCCTGAGGTCACATGCG |
| | | 248) | TGGTGGTGGACGTGAGCCACGAAGACCCTGAGGTCA |
| | | | AGTTCAACTGGTACGTGGACGGCGTGGAGGTGCATA |
| | | | ATGCCAAGACAAAGCCGTGCGAGGAGCAGTACGGC |
| | | | AGCACGTACCGTTGCGTCAGCGTCCTCACCGTCCTGC |
| | | | ACCAGGACTGGCTGAATGGCAAGGAGTACAAGTGC |
| | | | AAGGTGTCCAACAAAGCCCTCCCAGCCCCCATCGAG |
| | | | AAAACCATCTCCAAAGCCAAAGGGCAGCCCCGAGA |
| | | | ACCACAGGTGTACACCCTGCCCCCATCCCGGGAGGA |
| | | | GATGACCAAGAACCAGGTCAGCCTGACCTGCCTGGT |
| | | | CAAAGGCTTCTATCCCAGCGACATCGCCGTGGAGTG |
| | | | GGAGAGCAATGGGCAGCCGGAGAACAACTACGACA |
| | | | CCACGCCTCCCGTGCTGGACTCCGACGGCTCCTTCTT |
| | | | CCTCTATAGCGACCTCACCGTGGACAAGAGCAGGTG |
| | | | GCAGCAGGGGAACGTCTTCTCATGCTCCGTGATGCA |
| | | | TGAGGCTCTGCACAACCACTACACGCAGGACAGCCT |
| | | | CTCCCTGTCTCCGGGCAAA (SEQ ID NO: 329) |
| 101G | HC-108 | QVQLVESGGGVVQPGRSLRLS | CAGGTGCAGCTGGTGGAGTCTGGGGGAGGCGTGG |
| | | CAASGFTFSRFAMHWVRQAP | TCCAGCCTGGGAGGTCCCTGCGACTCTCCTGTGCAG |
| | | GKGLEWVAVISYQGRNKYYA | CCTCTGGATTCACCTTCAGTAGATTTGCCATGCACTG |
| | | ESVKGRFTISRDNSKNTLYLQ | GGTCCGCCAGGCTCCAGGCAAGGGGCTGGAGTGGGT |
| | | MNSLRAEDTALFYCARGYDV | GGCAGTTATCTCATATCAGGGACGCAATAAATACTA |
| | | LTGYPDYWGQGTLVTVSSAST | TGCAGAGTCCGTGAAGGGCCGGTTCACCATCTCCAG |
| | | KGPSVFPLAPSSKSTSGGTAAL | AGACAATTCCAAGAACACCCTGTATCTGCAAATGAA |
| | | GCLVKDYFPEPVTVSWNSGAL | CAGCCTGAGAGCTGAGGACACGGCTCTGTTTTACTG |
| | | TSGVHTFPAVLQSSGLYSLKS | TGCGAGAGGATACGATGTTTTGACTGGTTACCCCGA |
| | | VVTVPSSSLGTQTYICNVNHK | CTACTGGGGCCAGGGAACCCTGGTCACCGTGTCTAG |
| | | PSNTKVDKKVEPKSCDKTHTC | TGCCTCCACCAAGGGCCCATCGGTCTTCCCCCTGGCA |
| | | PPCPAPELLGGPSVFLFPPKPK | CCCTCCTCCAAGAGCACCTCTGGGGGCACAGCGGCC |
| | | DTLYITREPEVTCVVVDVSHE | CTGGGCTGCCTGGTCAAGGACTACTTCCCCGAACCG |
| | | DPEVKFNWYVDGVEVHNAKT | GTGACGGTGTCGTGGAACTCAGGCGCCCTGACCAGC |
| | | KPCEEQYGSTYRCVSVLTVLH | GGCGTGCACACCTTCCCGGCTGTCCTACAGTCCTCAG |
| | | QDWLNGKEYKCKVSNKALPA | GACTCTACTCCCTCAAGAGCGTGGTGACCGTGCCCT |
| | | PIEKTISKAKGQPREPQVYTLP | CCAGCAGCTTGGGCACCCAGACCTACATCTGCAACG |
| | | PSREEMTENQVSLTCLVEGFY | TGAATCACAAGCCCAGCAACACCAAGGTGGACAAG |
| | | PSDIAVEWESNGQPENNYETT | AAAGTTGAGCCCAAATCTTGTGACAAAACTCACACA |
| | | PPVLDSDGSFFLYSDLTVDKSR | TGCCCACCGTGCCCAGCACCTGAACTCCTGGGGGGA |
| | | WQQGNVFSCSVMHEALHNHY | CCGTCAGTCTTCCTCTTCCCCCCAAAACCCAAGGACA |
| | | TQKSLSLSPGK (SEQ ID NO: | CCCTCTATATCACCCGGGAGCCTGAGGTCACATGCG |
| | | 249) | TGGTGGTGGACGTGAGCCACGAAGACCCTGAGGTCA |
| | | | AGTTCAACTGGTACGTGGACGGCGTGGAGGTGCATA |
| | | | ATGCCAAGACAAAGCCGTGCGAGGAGCAGTACGGC |
| | | | AGCACGTACCGTTGCGTCAGCGTCCTCACCGTCCTGC |
| | | | ACCAGGACTGGCTGAATGGCAAGGAGTACAAGTGC |
| | | | AAGGTGTCCAACAAAGCCCTCCCAGCCCCCATCGAG |
| | | | AAAACCATCTCCAAAGCCAAAGGGCAGCCCCGAGA |
| | | | ACCACAGGTGTACACCCTGCCCCCATCCCGGGAGGA |
| | | | GATGACCGAGAACCAGGTCAGCCTGACCTGCCTGGT |
| | | | CGAGGGCTTCTATCCCAGCGACATCGCCGTGGAGTG |
| | | | GGAGAGCAATGGGCAGCCGGAGAACAACTACGAGA |
| | | | CCACGCCTCCCGTGCTGGACTCCGACGGCTCCTTCTT |
| | | | CCTCTATAGCGACCTCACCGTGGACAAGAGCAGGTG |
| | | | GCAGCAGGGGAACGTCTTCTCATGCTCCGTGATGCA |
| | | | TGAGGCTCTGCACAACCACTACACGCAGAAGAGCCT |
| | | | CTCCCTGTCTCCGGGCAAA (SEQ ID NO: 330) |
| 102A | HC-109 | QVQLVESGGGVVQPGRSLRLS | CAGGTGCAGCTGGTGGAGTCTGGGGGAGGCGTGGTC |
| | | CAASGFTFSRFAMHWVRQAP | CAGCCTGGGAGGTCCCTGCGACTCTCCTGTGCAGCC |
| | | GKGLEWVAVISYNGGNKYYA | TCTGGATTCACCTTCAGTAGATTTGCCATGCACTGGG |
| | | ESVKGRFTISRDNSKNTLYLQ | TCCGCCAGGCTCCAGGCAAGGGGCTGGAGTGGGTGG |
| | | MNSLRAEDTALFYCARGYDV | CAGTTATCTCATATAACGGAGGAAATAAATACTATG |
| | | LTGYPDYWGQGTLVTVSSAST | CAGAGTCCGTGAAGGGCCGGTTCACCATCTCCAGAG |
| | | KGPSVFPLAPSSKSTSGGTAAL | ACAATTCCAAGAACACCCTGTATCTGCAAATGAACA |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVKGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>250) | GCCTGAGAGCTGAGGACACGGCTCTGTTTTACTGTG<br>CGAGAGGATACGATGTTTTGACTGGTTACCCCGACT<br>ACTGGGGCCAGGGAACCCTGGTCACCGTGTCTAGTG<br>CCTCCACCAAGGGCCCATCGGTCTTCCCCCTGGCACC<br>CTCCTCCAAGAGCACCTCTGGGGGCACAGCGGCCCT<br>GGGCTGCCTGGTCAAGGACTACTTCCCCGAACCGGT<br>GACGGTGTCGTGGAACTCAGGCGCCCTGACCAGCGG<br>CGTGCACACCTTCCCGGCTGTCCTACAGTCCTCAGGA<br>CTCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCAAA<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 331) |
| 102B | HC-110 | QVQLVESGGGVVQPGRSLRLS<br>CAASGFTFSRFAMHWVRQAP<br>GKGLEWVAVISYNGGNKYYA<br>ESVKGRFTISRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVDGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>251) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>CAGTTATCTCATATAACGGAGGAAATAAATACTATG<br>CAGAGTCCGTGAAGGGCCGGTTCACCATCTCCAGAG<br>ACAATTCCAAGAACACCCTGTATCTGCAAATGAACA<br>GCCTGAGAGCTGAGGACACGGCTCTGTTTTACTGTG<br>CGAGAGGATACGATGTTTTGACTGGTTACCCCGACT<br>ACTGGGGCCAGGGAACCCTGGTCACCGTGTCTAGTG<br>CCTCCACCAAGGGCCCATCGGTCTTCCCCCTGGCACC<br>CTCCTCCAAGAGCACCTCTGGGGGCACAGCGGCCCT<br>GGGCTGCCTGGTCAAGGACTACTTCCCCGAACCGGT<br>GACGGTGTCGTGGAACTCAGGCGCCCTGACCAGCGG<br>CGTGCACACCTTCCCGGCTGTCCTACAGTCCTCAGGA<br>CTCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 332) |
| 102C | HC-111 | QVQLVESGGGVVQPGRSLRLS<br>CAASGFTFSRFAMHWVRQAP<br>GKGLEWVAVISYNGGNKYYA<br>ESVKGRFTISRDNSKNTLYLQ | CAGGTGCAGCTGGTGGAGTCTGGGGGAGGCGTGG<br>TCCAGCCTGGGAGGTCCCTGCGACTCTCCTGTGCAG<br>CCTCTGGATTCACCTTCAGTAGATTTGCCATGCACTG<br>GGTCCGCCAGGCTCCAGGCAAGGGGCTGGAGTGGGT |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQDSLSLSPGK (SEQ ID NO: 252) | GGCAGTTATCTCATATAACGGAGGAAATAAATACTA TGCAGAGTCCGTGAAGGGCCGGTTCACCATCTCCAG AGACAATTCCAAGAACACCCTGTATCTGCAAATGAA CAGCCTGAGAGCTGAGGACACGGCTCTGTTTTACTG TGCGAGAGGATACGATGTTTTGACTGGTTACCCCGA CTACTGGGGCCAGGGAACCCTGGTCACCGTGTCTAG TGCCTCCACCAAGGGCCCATCGGTCTTCCCCCTGGCA CCCTCCTCCAAGAGCACCTCTGGGGGCACAGCGGCC CTGGGCTGCCTGGTCAAGGACTACTTCCCCGAACCG GTGACGGTGTCGTGGAACTCAGGCGCCCTGACCAGC GGCGTGCACACCTTCCCGGCTGTCCTACAGTCCTCAG GACTCTACTCCCTCAAGAGCGTGGTGACCGTGCCCT CCAGCAGCTTGGGCACCCAGACCTACATCTGCAACG TGAATCACAAGCCCAGCAACACCAAGGTGGACAAG AAAGTTGAGCCCAAATCTTGTGACAAAACTCACACA TGCCCACCGTGCCCAGCACCTGAACTCCTGGGGGGA CCGTCAGTCTTCCTCTTCCCCCCAAAACCCAAGGACA CCCTCATGATCTCCCGGACCCCTGAGGTCACATGCGT GGTGGTGGACGTGAGCCACGAAGACCCTGAGGTCAA GTTCAACTGGTACGTGGACGGCGTGGAGGTGCATAA TGCCAAGACAAAGCCGTGCGAGGAGCAGTACGGCA GCACGTACCGTTGCGTCAGCGTCCTCACCGTCCTGCA CCAGGACTGGCTGAATGGCAAGGAGTACAAGTGCA AGGTGTCCAACAAAGCCCTCCCAGCCCCCATCGAGA AAACCATCTCCAAAGCCAAAGGGCAGCCCCGAGAA CCACAGGTGTACACCCTGCCCCCATCCCGGGAGGAG ATGACCAAGAACCAGGTCAGCCTGACCTGCCTGGTC AAAGGCTTCTATCCCAGCGACATCGCCGTGGAGTGG GAGAGCAATGGGCAGCCGGAGAACAACTACGACAC CACGCCTCCCGTGCTGGACTCCGACGGCTCCTTCTTC CTCTATAGCGACCTCACCGTGGACAAGAGCAGGTGG CAGCAGGGGAACGTCTTCTCATGCTCCGTGATGCAT GAGGCTCTGCACAACCACTACACGCAGGACAGCCTC TCCCTGTCTCCGGGCAAA (SEQ ID NO: 333) |
| 102D | HC-112 | QVQLVESGGGVVQPGRSLRLS CAASGFTFSRFAMHWVRQAP GKGLEWVAVISYNGGNKYYA ESVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTENQVSLTCLVEGFY PSDIAVEWESNGQPENNYETT PPVLDSDGSFFLYSDLTVDKSR WQQGNVFSCSVMHEALHNHY TQKSLSLSPGK (SEQ ID NO: 253) | CAGGTGCAGCTGGTGGAGTCTGGGGGAGGCGTGG TCCAGCCTGGGAGGTCCCTGCGACTCTCCTGTGCAG CCTCTGGATTCACCTTCAGTAGATTTGCCATGCACTG GGTCCGCCAGGCTCCAGGCAAGGGGCTGGAGTGGGT GGCAGTTATCTCATATAACGGAGGAAATAAATACTA TGCAGAGTCCGTGAAGGGCCGGTTCACCATCTCCAG AGACAATTCCAAGAACACCCTGTATCTGCAAATGAA CAGCCTGAGAGCTGAGGACACGGCTCTGTTTTACTG TGCGAGAGGATACGATGTTTTGACTGGTTACCCCGA CTACTGGGGCCAGGGAACCCTGGTCACCGTGTCTAG TGCCTCCACCAAGGGCCCATCGGTCTTCCCCCTGGCA CCCTCCTCCAAGAGCACCTCTGGGGGCACAGCGGCC CTGGGCTGCCTGGTCAAGGACTACTTCCCCGAACCG GTGACGGTGTCGTGGAACTCAGGCGCCCTGACCAGC GGCGTGCACACCTTCCCGGCTGTCCTACAGTCCTCAG GACTCTACTCCCTCAAGAGCGTGGTGACCGTGCCCT CCAGCAGCTTGGGCACCCAGACCTACATCTGCAACG TGAATCACAAGCCCAGCAACACCAAGGTGGACAAG AAAGTTGAGCCCAAATCTTGTGACAAAACTCACACA TGCCCACCGTGCCCAGCACCTGAACTCCTGGGGGGA CCGTCAGTCTTCCTCTTCCCCCCAAAACCCAAGGACA CCCTCATGATCTCCCGGACCCCTGAGGTCACATGCGT GGTGGTGGACGTGAGCCACGAAGACCCTGAGGTCAA GTTCAACTGGTACGTGGACGGCGTGGAGGTGCATAA TGCCAAGACAAAGCCGTGCGAGGAGCAGTACGGCA GCACGTACCGTTGCGTCAGCGTCCTCACCGTCCTGCA CCAGGACTGGCTGAATGGCAAGGAGTACAAGTGCA AGGTGTCCAACAAAGCCCTCCCAGCCCCCATCGAGA AAACCATCTCCAAAGCCAAAGGGCAGCCCCGAGAA CCACAGGTGTACACCCTGCCCCCATCCCGGGAGGAG ATGACCGAGAACCAGGTCAGCCTGACCTGCCTGGTC GAGGGCTTCTATCCCAGCGACATCGCCGTGGAGTGG GAGAGCAATGGGCAGCCGGAGAACAACTACGAAAC CACGCCTCCCGTGCTGGACTCCGACGGCTCCTTCTTC CTCTATAGCGACCTCACCGTGGACAAGAGCAGGTGG CAGCAGGGGAACGTCTTCTCATGCTCCGTGATGCAT GAGGCTCTGCACAACCACTACACGCAGAAGAGCCTC TCCCTGTCTCCGGGCAAA (SEQ ID NO: 334) |

TABLE 7B-continued

| Exemplary Anti-PAC1 Receptor Antibody Heavy Chain Sequences | | | |
|---|---|---|---|
| Antibody ID. | HC Group | Heavy Chain Amino Acid Sequence | Heavy Chain Nucleic Acid Sequence |
| 103A | HC-113 | QVQLVESGGGVVQPGRSLRLS<br>CAASGFTFSRFAMHWVRQAP<br>GKGLEWVGVISFSGGSKYYAE<br>SVKGRFTLSRDNSKNTLYLQM<br>NSLRAEDTALFYCARGYDVLT<br>GYPDYWGQGTLVTVSSASTK<br>GPSVFPLAPSSKSTSGGTAALG<br>CLVKDYFPEPVTVSWNSGALT<br>SGVHTFPAVLQSSGLYSLKSV<br>VTVPSSSLGTQTYICNVNHKPS<br>NTKVDKKVEPKSCDKTHTCPP<br>CPAPELLGGPSVFLFPPKPKDT<br>LMISRTPEVTCVVVDVSHEDP<br>EVKFNWYVDGVEVHNAKTKP<br>CEEQYGSTYRCVSVLTVLHQD<br>WLNGKEYKCKVSNKALPAPIE<br>KTISKAKGQPREPQVYTLPPSR<br>EEMTKNQVSLTCLVKGFYPSD<br>IAVEWESNGQPENNYDTTPPV<br>LDSDGSFFLYSDLTVDKSRWQ<br>QGNVFSCSVMHEALHNHYTQ<br>KSLSLSPGK (SEQ ID NO: 254) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>GTGTTATATCTTTTTCTGGAGGTTCTAAATACTATGC<br>AGAGTCCGTGAAGGGCCGGTTCACCTTGTCCAGAGA<br>CAATTCCAAGAACACCCTGTATCTGCAAATGAACAG<br>CCTGAGAGCTGAGGACACGGCTCTGTTTTACTGTGC<br>GAGAGGATACGATGTTTTGACTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCAAA<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 335) |
| 103B | HC-114 | QVQLVESGGGVVQPGRSLRLS<br>CAASGFTFSRFAMHWVRQAP<br>GKGLEWVGVISFSGGSKYYAE<br>SVKGRFTLSRDNSKNTLYLQM<br>NSLRAEDTALFYCARGYDVLT<br>GYPDYWGQGTLVTVSSASTK<br>GPSVFPLAPSSKSTSGGTAALG<br>CLVKDYFPEPVTVSWNSGALT<br>SGVHTFPAVLQSSGLYSLKSV<br>VTVPSSSLGTQTYICNVNHKPS<br>NTKVDKKVEPKSCDKTHTCPP<br>CPAPELLGGPSVFLFPPKPKDT<br>LMISRTPEVTCVVVDVSHEDP<br>EVKFNWYVDGVEVHNAKTKP<br>CEEQYGSTYRCVSVLTVLHQD<br>WLNGKEYKCKVSNKALPAPIE<br>KTISKAKGQPREPQVYTLPPSR<br>EEMTKNQVSLTCLVDGFYPSD<br>IAVEWESNGQPENNYDTTPPV<br>LDSDGSFFLYSDLTVDKSRWQ<br>QGNVFSCSVMHEALHNHYTQ<br>KSLSLSPGK (SEQ ID NO: 255) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>GTGTTATATCTTTTTCTGGAGGTTCTAAATACTATGC<br>AGAGTCCGTGAAGGGCCGGTTCACCTTGTCCAGAGA<br>CAATTCCAAGAACACCCTGTATCTGCAAATGAACAG<br>CCTGAGAGCTGAGGACACGGCTCTGTTTTACTGTGC<br>GAGAGGATACGATGTTTTGACTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG |

TABLE 7B-continued

| Exemplary Anti-PAC1 Receptor Antibody Heavy Chain Sequences | | | |
|---|---|---|---|
| Antibody ID. | HC Group | Heavy Chain Amino Acid Sequence | Heavy Chain Nucleic Acid Sequence |
| | | | CAGGGGAACGTCTTCTCATGCTCCGTGATGCATGAG GCTCTGCACAACCACTACACGCAGAAGAGCCTCTCC CTGTCTCCGGGTAAA (SEQ ID NO: 336) |
| 104A | HC-115 | QVQLVESGGGVVQPGRSLRLS CAASGFTFSRFAMHWVRQAP GKGLEWVGVINYRGHGKYYA ESVKGRFTVSRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 256) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG GTGTTATCAACTATCGTGGACATGGTAAATACTATG CAGAGTCCGTGAAGGGCCGGTTCACCGTGTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 337) |
| 104B | HC-116 | QVQLVESGGGVVQPGRSLRLS CAASGFTFSRFAMHWVRQAP GKGLEWVGVINYRGHGKYYA ESVKGRFTVSRDNSKNTLYLQ MNSLRAEDTALFYCARGYDV LTGYPDYWGQGTLVTVSSAST KGPS VFPLAPS SKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 257) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG GTGTTATCAACTATCGTGGACATGGTAAATACTATG CAGAGTCCGTGAAGGGCCGGTTCACCGTGTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCGAT GGCTTCTATCCCAGCGACATCGCCGTGGAGTGGGAG |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | | AGCAATGGGCAGCCGGAGAACAACTACGACCACGCCTCCCGTGCTGGACTCCGACGGCTCCTTCTTCCTCTATAGCGACCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 338) |
| 105A | HC-117 | QVQLVESGGGVVQPGRSLRLSCAASGFTFSRFAMHWVRQAPGKGLEWVGVISYSGASKYYAESVKGRFTMSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK (SEQ ID NO: 258) | CAGGTGCAGCTGGTGGAGTCTGGGGGAGGCGTGGTCCAGCCTGGGAGGTCCCTGCGACTCTCCTGTGCAGCCTCTGGATTCACCTTCAGTAGATTTGCCATGCACTGGGTCCGCCAGGCTCCAGGCAAGGGGCTGGAGTGGGTGGGTGTTATATCTTATTCTGGAGCTTCTAAATACTATGCAGAGTCCGTGAAGGGCCGGTTCACCATGTCCAGAGACAATTCCAAGAACACCCTGTATCTGCAAATGAACAGCCTGAGAGCTGAGGACACGGCTCTGTTTTACTGTGCGAGAGGATACGATGTTTTGACTGGTTACCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAAGAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACGACACCACGCCTCCCGTGCTGGACTCCGACGGCTCCTTCTTCCTCTATAGCGACCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 339) |
| 105B | HC-118 | QVQLVESGGGVVQPGRSLRLSCAASGFTFSRFAMHWVRQAPGKGLEWVGVISYSGASKYYAESVKGRFTMSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK (SEQ ID NO: 259) | CAGGTGCAGCTGGTGGAGTCTGGGGGAGGCGTGGTCCAGCCTGGGAGGTCCCTGCGACTCTCCTGTGCAGCCTCTGGATTCACCTTCAGTAGATTTGCCATGCACTGGGTCCGCCAGGCTCCAGGCAAGGGGCTGGAGTGGGTGGGTGTTATATCTTATTCTGGAGCTTCTAAATACTATGCAGAGTCCGTGAAGGGCCGGTTCACCATGTCCAGAGACAATTCCAAGAACACCCTGTATCTGCAAATGAACAGCCTGAGAGCTGAGGACACGGCTCTGTTTTACTGTGCGAGAGGATACGATGTTTTGACTGGTTACCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAAGAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCA |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | | CAGGTGTACACCCTGCCCCCATCCCGGGAGGAGATG ACCAAGAACCAGGTCAGCCTGACCTGCCTGGTCGAT GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 340) |
| 106A | HC-119 | QVQLVESGGGVVQPGRSLRLS CAASGFTFSRFAMHWVRQAP GKGLEWVAVISYSGAFKYYA ESVKGRFTVSRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 260) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CTGTTATATCTTATTCTGGAGCTTTCAAATACTATGC AGAGTCCGTGAAGGGCCGGTTCACCGTGTCCAGAGA CAATTCCAAGAACACCCTGTATCTGCAAATGAACAG CCTGAGAGCTGAGGACACGGCTCTGTTTTACTGTGC GAGAGGATACGATGTTTTGACTGGTTACCCCGACTA CTGGGGCCAGGGAACCCTGGTCACCGTGTCTAGTGC CTCCACCAAGGGCCCATCGGTCTTCCCCCTGGCACCC TCCTCCAAGAGCACCTCTGGGGGCACAGCGGCCCTG GGCTGCCTGGTCAAGGACTACTTCCCCGAACCGGTG ACGGTGTCGTGGAACTCAGGCGCCCTGACCAGCGGC GTGCACACCTTCCCGGCTGTCCTACAGTCCTCAGGAC TCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 341) |
| 106B | HC-120 | QVQLVESGGGVVQPGRSLRLS CAASGFTFSRFAMHWVRQAP GKGLEWVAVISYSGAFKYYA ESVKGRFTVSRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 261) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CTGTTATATCTTATTCTGGAGCTTTCAAATACTATGC AGAGTCCGTGAAGGGCCGGTTCACCGTGTCCAGAGA CAATTCCAAGAACACCCTGTATCTGCAAATGAACAG CCTGAGAGCTGAGGACACGGCTCTGTTTTACTGTGC GAGAGGATACGATGTTTTGACTGGTTACCCCGACTA CTGGGGCCAGGGAACCCTGGTCACCGTGTCTAGTGC CTCCACCAAGGGCCCATCGGTCTTCCCCCTGGCACCC TCCTCCAAGAGCACCTCTGGGGGCACAGCGGCCCTG GGCTGCCTGGTCAAGGACTACTTCCCCGAACCGGTG ACGGTGTCGTGGAACTCAGGCGCCCTGACCAGCGGC GTGCACACCTTCCCGGCTGTCCTACAGTCCTCAGGAC TCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | | AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 342) |
| 107A | HC-121 | QVQLVESGGGVVQPGRSLRLS<br>CAASGFTFSRFAMHWVRQAP<br>GKGLEWVGVISYTGAQKYYA<br>ESVKGRFTMSRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVKGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>262) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>GTGTTATATCTTATACTGGAGCTCAGAAATACTATGC<br>AGAGTCCGTGAAGGGCCGGTTCACCATGTCCAGAGA<br>CAATTCCAAGAACACCCTGTATCTGCAAATGAACAG<br>CCTGAGAGCTGAGGACACGGCTCTGTTTTACTGTGC<br>GAGAGGATACGATGTTTTGACTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCAAA<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 343) |
| 107B | HC-122 | QVQLVESGGGVVQPGRSLRLS<br>CAASGFTFSRFAMHWVRQAP<br>GKGLEWVGVISYTGAQKYYA<br>ESVKGRFTMSRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVDGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>263) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>GTGTTATATCTTATACTGGAGCTCAGAAATACTATGC<br>AGAGTCCGTGAAGGGCCGGTTCACCATGTCCAGAGA<br>CAATTCCAAGAACACCCTGTATCTGCAAATGAACAG<br>CCTGAGAGCTGAGGACACGGCTCTGTTTTACTGTGC<br>GAGAGGATACGATGTTTTGACTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | | TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 344) |
| 108A | HC-123 | QVQLVESGGGVVQPGRSLRLS<br>CAASGFTFSRFAMHWVRQAP<br>GKGLEWVGVISYTGQFKYYA<br>ESVKGRFTVSRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVKGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>264) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>GTGTTATCTCTTATACTGGACAGTTCAAATACTATGC<br>AGAGTCCGTGAAGGGCCGGTTCACCGTGTCCAGAGA<br>CAATTCCAAGAACACCCTGTATCTGCAAATGAACAG<br>CCTGAGAGCTGAGGACACGGCTCTGTTTTACTGTGC<br>GAGAGGATACGATGTTTTGACTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCAAA<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 345) |
| 108B | HC-124 | QVQLVESGGGVVQPGRSLRLS<br>CAASGFTFSRFAMHWVRQAP<br>GKGLEWVGVISYTGQFKYYA<br>ESVKGRFTVSRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>GTGTTATCTCTTATACTGGACAGTTCAAATACTATGC<br>AGAGTCCGTGAAGGGCCGGTTCACCGTGTCCAGAGA<br>CAATTCCAAGAACACCCTGTATCTGCAAATGAACAG<br>CCTGAGAGCTGAGGACACGGCTCTGTTTTACTGTGC<br>GAGAGGATACGATGTTTTGACTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | PSREEMTKNQVSLTCLVDGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>265) | ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 346) |
| 109A | HC-125 | QVQLVESGGGVVQPGRSLRLS<br>CAASGFTFSKYAMHWVRQAP<br>GKGLEWVAVISYMGANKYYA<br>ESVKGRFTISRDNSKNTLYLQ<br>MNSLRAEDTALFYCARGYDL<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVKGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>266) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAAATACGCCATGCACTGG<br>GTCCGCCAGGCTCCAGGCAAGGGGCTGGAGTGGGTG<br>GCAGTTATCTCATACATGGGAGCTAATAAATACTAT<br>GCAGAGTCCGTGAAGGGCCGGTTCACCATCTCCAGA<br>GACAATTCCAAGAACACCCTGTATCTGCAAATGAAC<br>AGCCTGAGAGCTGAGGACACGGCTCTGTTTTACTGT<br>GCGAGAGGATACGATCTGCTGACTGGTTACCCCGAC<br>TACTGGGGCCAGGGAACCCTGGTCACCGTGTCTAGT<br>GCCTCCACCAAGGGCCCATCGGTCTTCCCCCTGGCA<br>CCCTCCTCCAAGAGCACCTCTGGGGGCACAGCGGCC<br>CTGGGCTGCCTGGTCAAGGACTACTTCCCCGAACCG<br>GTGACGGTGTCGTGGAACTCAGGCGCCCTGACCAGC<br>GGCGTGCACACCTTCCCGGCTGTCCTACAGTCCTCAG<br>GACTCTACTCCCTCAAGAGCGTGGTGACCGTGCCCT<br>CCAGCAGCTTGGGCACCCAGACCTACATCTGCAACG<br>TGAATCACAAGCCCAGCAACACCAAGGTGGACAAG<br>AAAGTTGAGCCCAAATCTTGTGACAAAACTCACACA<br>TGCCCACCGTGCCCAGCACCTGAACTCCTGGGGGGA<br>CCGTCAGTCTTCCTCTTCCCCCCAAAACCCAAGGACA<br>CCCTCATGATCTCCCGGACCCCTGAGGTCACATGCGT<br>GGTGGTGGACGTGAGCCACGAAGACCCTGAGGTCAA<br>GTTCAACTGGTACGTGGACGGCGTGGAGGTGCATAA<br>TGCCAAGACAAAGCCGTGCGAGGAGCAGTACGGCA<br>GCACGTACCGTTGCGTCAGCGTCCTCACCGTCCTGCA<br>CCAGGACTGGCTGAATGGCAAGGAGTACAAGTGCA<br>AGGTGTCCAACAAAGCCCTCCCAGCCCCCATCGAGA<br>AAACCATCTCCAAAGCCAAAGGGCAGCCCCGAGAA<br>CCACAGGTGTACACCCTGCCCCCATCCCGGGAGGAG<br>ATGACCAAGAACCAGGTCAGCCTGACCTGCCTGGTC<br>AAAGGCTTCTATCCCAGCGACATCGCCGTGGAGTGG<br>GAGAGCAATGGGCAGCCGGAGAACAACTACGACAC<br>CACGCCTCCCGTGCTGGACTCCGACGGCTCCTTCTTC<br>CTCTATAGCGACCTCACCGTGGACAAGAGCAGGTGG<br>CAGCAGGGGAACGTCTTCTCATGCTCCGTGATGCAT<br>GAGGCTCTGCACAACCACTACACGCAGAAGAGCCTC<br>TCCCTGTCTCCGGGTAAA (SEQ ID NO: 347) |
| 109B | HC-126 | QVQLVESGGGVVQPGRSLRLS<br>CAASGFTFSKYAMHWVRQAP<br>GKGLEWVAVISYMGANKYYA<br>ESVKGRFTISRDNSKNTLYLQ<br>MNSLRAEDTALFYCARGYDL<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAAATACGCCATGCACTGG<br>GTCCGCCAGGCTCCAGGCAAGGGGCTGGAGTGGGTG<br>GCAGTTATCTCATACATGGGAGCTAATAAATACTAT<br>GCAGAGTCCGTGAAGGGCCGGTTCACCATCTCCAGA<br>GACAATTCCAAGAACACCCTGTATCTGCAAATGAAC<br>AGCCTGAGAGCTGAGGACACGGCTCTGTTTTACTGT<br>GCGAGAGGATACGATCTGCTGACTGGTTACCCCGAC<br>TACTGGGGCCAGGGAACCCTGGTCACCGTGTCTAGT<br>GCCTCCACCAAGGGCCCATCGGTCTTCCCCCTGGCA<br>CCCTCCTCCAAGAGCACCTCTGGGGGCACAGCGGCC<br>CTGGGCTGCCTGGTCAAGGACTACTTCCCCGAACCG<br>GTGACGGTGTCGTGGAACTCAGGCGCCCTGACCAGC |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 267) | GGCGTGCACACCTTCCCGGCTGTCCTACAGTCCTCAG GACTCTACTCCCTCAAGAGCGTGGTGACCGTGCCCT CCAGCAGCTTGGGCACCCAGACCTACATCTGCAACG TGAATCACAAGCCCAGCAACACCAAGGTGGACAAG AAAGTTGAGCCCAAATCTTGTGACAAAACTCACACA TGCCCACCGTGCCCAGCACCTGAACTCCTGGGGGGA CCGTCAGTCTTCCTCTTCCCCCCAAAACCCAAGGACA CCCTCATGATCTCCCGGACCCCTGAGGTCACATGCGT GGTGGTGGACGTGAGCCACGAAGACCCTGAGGTCAA GTTCAACTGGTACGTGGACGGCGTGGAGGTGCATAA TGCCAAGACAAAGCCGTGCGAGGAGCAGTACGGCA GCACGTACCGTTGCGTCAGCGTCCTCACCGTCCTGCA CCAGGACTGGCTGAATGGCAAGGAGTACAAGTGCA AGGTGTCCAACAAAGCCCTCCCAGCCCCCATCGAGA AAACCATCTCCAAAGCCAAAGGGCAGCCCCGAGAA CCACAGGTGTACACCCTGCCCCCATCCCGGGAGGAG ATGACCAAGAACCAGGTCAGCCTGACCTGCCTGGTC GATGGCTTCTATCCCAGCGACATCGCCGTGGAGTGG GAGAGCAATGGGCAGCCGGAGAACAACTACGACAC CACGCCTCCCGTGCTGGACTCCGACGGCTCCTTCTTC CTCTATAGCGACCTCACCGTGGACAAGAGCAGGTGG CAGCAGGGGAACGTCTTCTCATGCTCCGTGATGCAT GAGGCTCTGCACAACCACTACACGCAGAAGAGCCTC TCCCTGTCTCCGGGTAAA (SEQ ID NO: 348) |
| 110A | HC-127 | QVQLVESGGGVVQPGRSLRLS CAASGFTFSRFAMHWVRQAP GKGLEWVGVINFQGTTKYYA ESVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 268) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG GTGTTATCAACTTTCAGGGAACTACTAAATACTATGC AGAGTCCGTGAAGGGCCGGTTCACCATCTCCAGAGA CAATTCCAAGAACACCCTGTATCTGCAAATGAACAG CCTGAGAGCTGAGGACACGGCTCTGTTTTACTGTGC GAGAGGATACGATGTTTTGACTGGTTACCCCGACTA CTGGGGCCAGGGAACCCTGGTCACCGTGTCTAGTGC CTCCACCAAGGGCCCATCGGTCTTCCCCCTGGCACCC TCCTCCAAGAGCACCTCTGGGGGCACAGCGGCCCTG GGCTGCCTGGTCAAGGACTACTTCCCCGAACCGGTG ACGGTGTCGTGGAACTCAGGCGCCCTGACCAGCGGC GTGCACACCTTCCCGGCTGTCCTACAGTCCTCAGGAC TCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 349) |
| 110B | HC-128 | QVQLVESGGGVVQPGRSLRLS CAASGFTFSRFAMHWVRQAP GKGLEWVGVINFQGTTKYYA ESVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG GTGTTATCAACTTTCAGGGAACTACTAAATACTATGC AGAGTCCGTGAAGGGCCGGTTCACCATCTCCAGAGA CAATTCCAAGAACACCCTGTATCTGCAAATGAACAG CCTGAGAGCTGAGGACACGGCTCTGTTTTACTGTGC GAGAGGATACGATGTTTTGACTGGTTACCCCGACTA CTGGGGCCAGGGAACCCTGGTCACCGTGTCTAGTGC CTCCACCAAGGGCCCATCGGTCTTCCCCCTGGCACCC |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 269) | TCCTCCAAGAGCACCTCTGGGGGCACAGCGGCCCTG GGCTGCCTGGTCAAGGACTACTTCCCCGAACCGGTG ACGGTGTCGTGGAACTCAGGCGCCCTGACCAGCGGC GTGCACACCTTCCCGGCTGTCCTACAGTCCTCAGGAC TCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCGAT GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 350) |
| 111A | HC-129 | QVQLVESGGGVVQPGRSLRLS CAASGFTFSRFAMHWVRQAP GKGLEWVGVISYSGDLKYYA ESVKGRFTVSRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 270) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG GTGTTATATCTTATTCTGGAGATCTGAAATACTATGC AGAGTCCGTGAAGGGCCGGTTCACCGTGTCCAGAGA CAATTCCAAGAACACCCTGTATCTGCAAATGAACAG CCTGAGAGCTGAGGACACGGCTCTGTTTTACTGTGC GAGAGGATACGATGTTTTGACTGGTTACCCCGACTA CTGGGGCCAGGGAACCCTGGTCACCGTGTCTAGTGC CTCCACCAAGGGCCCATCGGTCTTCCCCCTGGCACCC TCCTCCAAGAGCACCTCTGGGGGCACAGCGGCCCTG GGCTGCCTGGTCAAGGACTACTTCCCCGAACCGGTG ACGGTGTCGTGGAACTCAGGCGCCCTGACCAGCGGC GTGCACACCTTCCCGGCTGTCCTACAGTCCTCAGGAC TCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 351) |
| 111B | HC-130 | QVQLVESGGGVVQPGRSLRLS CAASGFTFSRFAMHWVRQAP GKGLEWVGVISYSGDLKYYA ESVKGRFTVSRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG GTGTTATATCTTATTCTGGAGATCTGAAATACTATGC AGAGTCCGTGAAGGGCCGGTTCACCGTGTCCAGAGA CAATTCCAAGAACACCCTGTATCTGCAAATGAACAG CCTGAGAGCTGAGGACACGGCTCTGTTTTACTGTGC |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVDGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>271) | GAGAGGATACGATGTTTTGACTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 352) |
| 112A | HC-131 | QVQLVESGGGVVQPGRSLRLS<br>CAASGFTFSRFAMHWVRQAP<br>GKGLEWVGVITYTGGAKYYA<br>ESVKGRFTISRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVKGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>272) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>GTGTTATAACTTATACTGGAGGTGCTAAATACTATGC<br>AGAGTCCGTGAAGGGCCGGTTCACCATCTCCAGAGA<br>CAATTCCAAGAACACCCTGTATCTGCAAATGAACAG<br>CCTGAGAGCTGAGGACACGGCTCTGTTTTACTGTGC<br>GAGAGGATACGATGTTTTGACTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCAAA<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 353) |
| 112B | HC-132 | QVQLVESGGGVVQPGRSLRLS<br>CAASGFTFSRFAMHWVRQAP<br>GKGLEWVGVITYTGGAKYYA<br>ESVKGRFTISRDNSKNTLYLQ<br>MNSLRAEDTALFYCARGYDV | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>GTGTTATAACTTATACTGGAGGTGCTAAATACTATGC |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVDGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>273) | AGAGTCCGTGAAGGGCCGGTTCACCATCTCCAGAGA<br>CAATTCCAAGAACACCCTGTATCTGCAAATGAACAG<br>CCTGAGAGCTGAGGACACGGCTCTGTTTTACTGTGC<br>GAGAGGATACGATGTTTTGACTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 354) |
| 113A | HC-133 | QVQLVESGGGVVQPGRSLRLS<br>CAASGFTFSKYAMHWVRQAP<br>GKGLEWVAVISYSGANKYYA<br>ESVKGRFTISRDNSKNTLYLQ<br>MNSLRAEDTALFYCARGYDL<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVKGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>274) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAAATACGCCATGCACTGG<br>GTCCGCCAGGCTCCAGGCAAGGGGCTGGAGTGGGTG<br>GCAGTTATCTCATACTCTGGAGCTAATAAATACTATG<br>CAGAGTCCGTGAAGGGCCGGTTCACCATCTCCAGAG<br>ACAATTCCAAGAACACCCTGTATCTGCAAATGAACA<br>GCCTGAGAGCTGAGGACACGGCTCTGTTTTACTGTG<br>CGAGAGGATACGATCTGCTGACTGGTTACCCCGACT<br>ACTGGGGCCAGGGAACCCTGGTCACCGTGTCTAGTG<br>CCTCCACCAAGGGCCCATCGGTCTTCCCCCTGGCACC<br>CTCCTCCAAGAGCACCTCTGGGGGCACAGCGGCCCT<br>GGGCTGCCTGGTCAAGGACTACTTCCCCGAACCGGT<br>GACGGTGTCGTGGAACTCAGGCGCCCTGACCAGCGG<br>CGTGCACACCTTCCCGGCTGTCCTACAGTCCTCAGGA<br>CTCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCAAA<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 355) |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| 113B | HC-134 | QVQLVESGGGVVQPGRSLRLS CAASGFTFSKYAMHWVRQAP GKGLEWVAVISYSGANKYYA ESVKGRFTISRDNSKNTLYLQ MNSLRAEDTALFYCARGYDL LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 275) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAAATACGCCATGCACTGG GTCCGCCAGGCTCCAGGCAAGGGGCTGGAGTGGGTG GCAGTTATCTCATACTCTGGAGCTAATAAATACTATG CAGAGTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATCTGCTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCGAT GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 356) |
| 114A | HC-135 | QVQLVESGGGVVQPGRSLRLS CAASGFTFSYYAMHWVRQAP GKGLEWVAVISHYGTNKYYA ESVKGRFTISRDNSKNTLYLQ MNSLRAEDTALFYCARGYDP LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 276) | CAGGTGCAGCTGGTGGAGTCTGGGGGAGGCGTGGTC CAGCCTGGGAGGTCCCTGCGACTCTCCTGTGCAGCC TCTGGATTCACCTTCAGTTACTACGCCATGCACTGGG TCCGCCAGGCTCCAGGCAAGGGGCTGGAGTGGGTGG CAGTTATCTCACATTACGGAACTAATAAATACTATG CAGAGTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATCCTCTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | | CAGGGGAACGTCTTCTCATGCTCCGTGATGCATGAG GCTCTGCACAACCACTACACGCAGAAGAGCCTCTCC CTGTCTCCGGGTAAA (SEQ ID NO: 357) |
| 114B | HC-136 | QVQLVESGGGVVQPGRSLRLS CAASGFTFSYYAMHWVRQAP GKGLEWVAVISHYGTNKYYA ESVKGRFTISRDNSKNTLYLQ MNSLRAEDTALFYCARGYDP LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 277) | CAGGTGCAGCTGGTGGAGTCTGGGGGAGGCGTGGTC CAGCCTGGGAGGTCCCTGCGACTCTCCTGTGCAGCC TCTGGATTCACCTTCAGTTACTACGCCATGCACTGGG TCCGCCAGGCTCCAGGCAAGGGGCTGGAGTGGGTGG CAGTTATCTCACATTACGGAACTAATAAATACTATG CAGAGTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATCCTCTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCGAT GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 358) |
| 115A | HC-137 | QVQLVESGGGVVQPGRSLRLS CAASGFTFSHYAMHWVRQAP GKGLEWVAVISYQGSNKYYA ESVKGRFTISRDNSKNTLYLQ MNSLRAEDTALFYCARGYDL LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 278) | CAGGTGCAGCTGGTGGAGTCTGGGGGAGGCGTGGTC CAGCCTGGGAGGTCCCTGCGACTCTCCTGTGCAGCC TCTGGATTCACCTTCAGTCATTACGCCATGCACTGGG TCCGCCAGGCTCCAGGCAAGGGGCTGGAGTGGGTGG CAGTTATCTCATACCAGGGAAGTAATAAATACTATG CAGAGTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATCTGCTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG |

TABLE 7B-continued

| Exemplary Anti-PAC1 Receptor Antibody Heavy Chain Sequences | | | |
|---|---|---|---|
| Antibody ID. | HC Group | Heavy Chain Amino Acid Sequence | Heavy Chain Nucleic Acid Sequence |
| | | | AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 359) |
| 115B | HC-138 | QVQLVESGGGVVQPGRSLRLS CAASGFTFSHYAMHWVRQAP GKGLEWVAVISYQGSNKYYA ESVKGRFTISRDNSKNTLYLQ MNSLRAEDTALFYCARGYDL LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 279) | CAGGTGCAGCTGGTGGAGTCTGGGGGAGGCGTGGTC CAGCCTGGGAGGTCCCTGCGACTCTCCTGTGCAGCC TCTGGATTCACCTTCAGTCATTACGCCATGCACTGGG TCCGCCAGGCTCCAGGCAAGGGGCTGGAGTGGGTGG CAGTTATCTCATACCAGGGAAGTAATAAATACTATG CAGAGTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATCTGCTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCGAT GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 360) |
| 116A | HC-139 | QVQLVESGGGVVQPGRSLRLS CAASGFTFSRFAMHWVRQAP GKGLEWVGVINYFGDAKYYA ESVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 280) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG GTGTTATCAACTATTTCGGAGACGCTAAATACTATGC AGAGTCCGTGAAGGGCCGGTTCACCATCTCCAGAGA CAATTCCAAGAACACCCTGTATCTGCAAATGAACAG CCTGAGAGCTGAGGACACGGCTCTGTTTTACTGTGC GAGAGGATACGATGTTTTGACTGGTTACCCCGACTA CTGGGGCCAGGGAACCCTGGTCACCGTGTCTAGTGC CTCCACCAAGGGCCCATCGGTCTTCCCCCTGGCACCC TCCTCCAAGAGCACCTCTGGGGGCACAGCGGCCCTG GGCTGCCTGGTCAAGGACTACTTCCCCGAACCGGTG ACGGTGTCGTGGAACTCAGGCGCCCTGACCAGCGGC GTGCACACCTTCCCGGCTGTCCTACAGTCCTCAGGAC TCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | | CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 361) |
| 116B | HC-140 | QVQLVESGGGVVQPGRSLRLS CAASGFTFSRFAMHWVRQAP GKGLEWVGVINYFGDAKYYA ESVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 281) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG GTGTTATCAACTATTTCGGAGACGCTAAATACTATGC AGAGTCCGTGAAGGGCCGGTTCACCATCTCCAGAGA CAATTCCAAGAACACCCTGTATCTGCAAATGAACAG CCTGAGAGCTGAGGACACGGCTCTGTTTTACTGTGC GAGAGGATACGATGTTTTGACTGGTTACCCCGACTA CTGGGGCCAGGGAACCCTGGTCACCGTGTCTAGTGC CTCCACCAAGGGCCCATCGGTCTTCCCCCTGGCACCC TCCTCCAAGAGCACCTCTGGGGGCACAGCGGCCCTG GGCTGCCTGGTCAAGGACTACTTCCCCGAACCGGTG ACGGTGTCGTGGAACTCAGGCGCCCTGACCAGCGGC GTGCACACCTTCCCGGCTGTCCTACAGTCCTCAGGAC TCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCGAT GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 362) |
| 117A | HC-141 | QVQLVESGGGVVQPGRSLRLS CAASGFTFSYFAMHWVRQAP GKGLEWVAVISHSGANKYYA ESVKGRFTISRDNSKNTLYLQ MNSLRAEDTALFYCARGYDL LSGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 282) | CAGGTGCAGCTGGTGGAGTCTGGGGGAGGCGTGGTC CAGCCTGGGAGGTCCCTGCGACTCTCCTGTGCAGCC TCTGGATTCACCTTCAGTTACTTCGCCATGCACTGGG TCCGCCAGGCTCCAGGCAAGGGGCTGGAGTGGGTGG CAGTTATCTCACATTCTGGAGCTAATAAATACTATGC AGAGTCCGTGAAGGGCCGGTTCACCATCTCCAGAGA CAATTCCAAGAACACCCTGTATCTGCAAATGAACAG CCTGAGAGCTGAGGACACGGCTCTGTTTTACTGTGC GAGAGGATACGATCTGCTGAGTGGTTACCCCGACTA CTGGGGCCAGGGAACCCTGGTCACCGTGTCTAGTGC CTCCACCAAGGGCCCATCGGTCTTCCCCCTGGCACCC TCCTCCAAGAGCACCTCTGGGGGCACAGCGGCCCTG GGCTGCCTGGTCAAGGACTACTTCCCCGAACCGGTG ACGGTGTCGTGGAACTCAGGCGCCCTGACCAGCGGC GTGCACACCTTCCCGGCTGTCCTACAGTCCTCAGGAC TCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC |

TABLE 7B-continued

| Exemplary Anti-PAC1 Receptor Antibody Heavy Chain Sequences | | | |
|---|---|---|---|
| Antibody ID. | HC Group | Heavy Chain Amino Acid Sequence | Heavy Chain Nucleic Acid Sequence |
| | | | AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCAAA<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 363) |
| 117B | HC-142 | QVQLVESGGGVVQPGRSLRLS<br>CAASGFTFSYFAMHWVRQAP<br>GKGLEWVAVISHSGANKYYA<br>ESVKGRFTISRDNSKNTLYLQ<br>MNSLRAEDTALFYCARGYDL<br>LSGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVDGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>283) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTTACTTCGCCATGCACTGGG<br>TCCGCCAGGCTCCAGGCAAGGGGCTGGAGTGGGTGG<br>CAGTTATCTCACATTCTGGAGCTAATAAATACTATGC<br>AGAGTCCGTGAAGGGCCGGTTCACCATCTCCAGAGA<br>CAATTCCAAGAACACCCTGTATCTGCAAATGAACAG<br>CCTGAGAGCTGAGGACACGGCTCTGTTTTACTGTGC<br>GAGAGGATACGATCTGCTGAGTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 364) |
| 118A | HC-143 | QVQLVESGGGVVQPGRSLRLS<br>CAASGFTFSYYAMHWVRQAP<br>GKGLEWVAVISYSGSNKYYA<br>ESVKGRFTISRDNSKNTLYLQ<br>MNSLRAEDTALFYCARGYDL<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVKGFY | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTTACTACGCCATGCACTGGG<br>TCCGCCAGGCTCCAGGCAAGGGGCTGGAGTGGGTGG<br>CAGTTATCTCATACTCTGGAAGTAATAAATACTATGC<br>AGAGTCCGTGAAGGGCCGGTTCACCATCTCCAGAGA<br>CAATTCCAAGAACACCCTGTATCTGCAAATGAACAG<br>CCTGAGAGCTGAGGACACGGCTCTGTTTTACTGTGC<br>GAGAGGATACGATCTGCTGACTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA |

TABLE 7B-continued

| Exemplary Anti-PAC1 Receptor Antibody Heavy Chain Sequences | | | |
|---|---|---|---|
| Antibody ID. | HC Group | Heavy Chain Amino Acid Sequence | Heavy Chain Nucleic Acid Sequence |
| | | PSDIAVEWESNGQPENNYDTT PPVLDSDGSFFLYSDLTVDKSR WQQGNVFSCSVMHEALHNHY TQKSLSLSPGK (SEQ ID NO: 284) | GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 365) |
| 118B | HC-144 | QVQLVESGGGVVQPGRSLRLS CAASGFTFSYYAMHWVRQAP GKGLEWVAVISYSGSNKYYA ESVKGRFTISRDNSKNTLYLQ MNSLRAEDTALFYCARGYDL LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 285) | CAGGTGCAGCTGGTGGAGTCTGGGGGAGGCGTGGTC CAGCCTGGGAGGTCCCTGCGACTCTCCTGTGCAGCC TCTGGATTCACCTTCAGTTACTACGCCATGCACTGGG TCCGCCAGGCTCCAGGCAAGGGGCTGGAGTGGGTGG CAGTTATCTCATACTCTGGAAGTAATAAATACTATGC AGAGTCCGTGAAGGGCCGGTTCACCATCTCCAGAGA CAATTCCAAGAACACCCTGTATCTGCAAATGAACAG CCTGAGAGCTGAGGACACGGCTCTGTTTTACTGTGC GAGAGGATACGATCTGCTGACTGGTTACCCCGACTA CTGGGGCCAGGGAACCCTGGTCACCGTGTCTAGTGC CTCCACCAAGGGCCCATCGGTCTTCCCCCTGGCACCC TCCTCCAAGAGCACCTCTGGGGGCACAGCGGCCCTG GGCTGCCTGGTCAAGGACTACTTCCCCGAACCGGTG ACGGTGTCGTGGAACTCAGGCGCCCTGACCAGCGGC GTGCACACCTTCCCGGCTGTCCTACAGTCCTCAGGAC TCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCGAT GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 366) |
| 119A | HC-145 | QVQLVESGGGVVQPGRSLRLS CAASGFTFSFYAMHWVRQAP GKGLEWVAVISSFGSNKYYAE SVKGRFTISRDNSKNTLYLQM NSLRAEDTALFYCARGYDLLT GYPDYWGQGTLVTVSSASTK GPSVFPLAPSSKSTSGGTAALG CLVKDYFPEPVTVSWNSGALT SGVHTFPAVLQSSGLYSLKSV VTVPSSSLGTQTYICNVNHKPS NTKVDKKVEPKSCDKTHTCPP CPAPELLGGPSVFLFPPKPKDT LMISRTPEVTCVVVDVSHEDP EVKFNWYVDGVEVHNAKTKP CEEQYGSTYRCVSVLTVLHQD | CAGGTGCAGCTGGTGGAGTCTGGGGGAGGCGTGGTC CAGCCTGGGAGGTCCCTGAGACTCTCCTGTGCAGCC TCTGGATTCACCTTCAGTTTCTACGCCATGCACTGGG TCCGCCAGGCTCCAGGCAAGGGGCTGGAGTGGGTGG CAGTTATCTCATCTTTCGGAAGTAATAAATACTATGC AGAGTCCGTGAAGGGCCGGTTCACCATCTCCAGAGA CAATTCCAAGAACACCCTGTATCTGCAAATGAACAG CCTGAGAGCTGAGGACACGGCTCTGTTTTACTGTGC GAGAGGATACGATCTGCTGACTGGTTACCCCGACTA CTGGGGCCAGGGAACCCTGGTCACCGTGTCTAGTGC CTCCACCAAGGGCCCATCGGTCTTCCCCCTGGCACCC TCCTCCAAGAGCACCTCTGGGGGCACAGCGGCCCTG GGCTGCCTGGTCAAGGACTACTTCCCCGAACCGGTG ACGGTGTCGTGGAACTCAGGCGCCCTGACCAGCGGC GTGCACACCTTCCCGGCTGTCCTACAGTCCTCAGGAC |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | WLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK (SEQ ID NO: 286) | TCTACTCCCTCAAGAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACGACACCACGCCTCCCGTGCTGGACTCCGACGGCTCCTTCTTCCTCTATAGCGACCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 367) |
| 119B | HC-146 | QVQLVESGGGVVQPGRSLRLSCAASGFTFSFYAMHWVRQAPGKGLEWVAVISSFGSNKYYAESVKGRFTISRDNSKNTLYLQMNSLRAEDTALFYCARGYDLLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK (SEQ ID NO: 287) | CAGGTGCAGCTGGTGGAGTCTGGGGGAGGCGTGGTCCAGCCTGGGAGGTCCCTGAGACTCTCCTGTGCAGCCTCTGGATTCACCTTCAGTTTCTACGCCATGCACTGGGTCCGCCAGGCTCCAGGCAAGGGGCTGGAGTGGGTGGCAGTTATCTCATCTTTCGGAAGTAATAAATACTATGCAGAGTCCGTGAAGGGCCGGTTCACCATCTCCAGAGACAATTCCAAGAACACCCTGTATCTGCAAATGAACAGCCTGAGAGCTGAGGACACGGCTCTGTTTTACTGTGCGAGAGGATACGATCTGCTGACTGGTTACCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAAGAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCGATGGCTTCTATCCCAGCGACATCGCCGTGGAGTGGGAGAGCAATGGGCAGCCGGAGAACAACTACGACACCACGCCTCCCGTGCTGGACTCCGACGGCTCCTTCTTCCTCTATAGCGACCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 368) |
| 120A | HC-147 | QVQLVESGGGVVQPGRSLRLSCAASGFTFSRYAMHWVRQAPGKGLEWVAVISYSGANKYYAESVKGRFTISRDNSKNTLYLQMNSLRAEDTALFYCARGYDLLSGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPK | CAGGTGCAGCTGGTGGAGTCTGGGGGAGGCGTGGTCCAGCCTGGGAGGTCCCTGCGACTCTCCTGTGCAGCCTCTGGATTCACCTTCAGTCGTTACGCCATGCACTGGGTCCGCCAGGCTCCAGGCAAGGGGCTGGAGTGGGTGGCAGTTATCTCATACTCTGGAGCTAATAAATACTATGCAGAGTCCGTGAAGGGCCGGTTCACCATCTCCAGAGACAATTCCAAGAACACCCTGTATCTGCAAATGAACAGCCTGAGAGCTGAGGACACGGCTCTGTTTTACTGTGCGAGAGGATACGATCTGCTGAGTGGTTACCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTG |

TABLE 7B-continued

| Exemplary Anti-PAC1 Receptor Antibody Heavy Chain Sequences | | | |
|---|---|---|---|
| Antibody ID. | HC Group | Heavy Chain Amino Acid Sequence | Heavy Chain Nucleic Acid Sequence |
| | | DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 288) | GGCTGCCTGGTCAAGGACTACTTCCCCGAACCGGTG ACGGTGTCGTGGAACTCAGGCGCCCTGACCAGCGGC GTGCACACCTTCCCGGCTGTCCTACAGTCCTCAGGAC TCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 369) |
| 120B | HC-148 | QVQLVESGGGVVQPGRSLRLS CAASGFTFSRYAMHWVRQAP GKGLEWVAVISYSGANKYYA ESVKGRFTISRDNSKNTLYLQ MNSLRAEDTALFYCARGYDL LSGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 289) | CAGGTGCAGCTGGTGGAGTCTGGGGGAGGCGTGGTC CAGCCTGGGAGGTCCCTGCGACTCTCCTGTGCAGCC TCTGGATTCACCTTCAGTCGTTACGCCATGCACTGGG TCCGCCAGGCTCCAGGCAAGGGGCTGGAGTGGGTGG CAGTTATCTCATACTCTGGAGCTAATAAATACTATGC AGAGTCCGTGAAGGGCCGGTTCACCATCTCCAGAGA CAATTCCAAGAACACCCTGTATCTGCAAATGAACAG CCTGAGAGCTGAGGACACGGCTCTGTTTTACTGTGC GAGAGGATACGATCTGCTGAGTGGTTACCCCGACTA CTGGGGCCAGGGAACCCTGGTCACCGTGTCTAGTGC CTCCACCAAGGGCCCATCGGTCTTCCCCCTGGCACCC TCCTCCAAGAGCACCTCTGGGGGCACAGCGGCCCTG GGCTGCCTGGTCAAGGACTACTTCCCCGAACCGGTG ACGGTGTCGTGGAACTCAGGCGCCCTGACCAGCGGC GTGCACACCTTCCCGGCTGTCCTACAGTCCTCAGGAC TCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCGAT GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 370) |
| 121A, 123A | HC-149 | QVQLVESGGGVVQPGRSLRLS CAASGFTFSRFAMHWVRQAP GKGLEWVAVISYIGGNKYYA ESVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CAGTTATCTCATATATCGGAGGAAATAAATACTATG CAGAGTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVKGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>290) | ACTGGGGCCAGGGAACCCTGGTCACCGTGTCTAGTG<br>CCTCCACCAAGGGCCCATCGGTCTTCCCCCTGGCACC<br>CTCCTCCAAGAGCACCTCTGGGGGCACAGCGGCCCT<br>GGGCTGCCTGGTCAAGGACTACTTCCCCGAACCGGT<br>GACGGTGTCGTGGAACTCAGGCGCCCTGACCAGCGG<br>CGTGCACACCTTCCCGGCTGTCCTACAGTCCTCAGGA<br>CTCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCAAA<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 371) |
| 121B,<br>123B | HC-150 | QVQLVESGGGVVQPGRSLRLS<br>CAASGFTFSRFAMHWVRQAP<br>GKGLEWVAVISYIGGNKYYA<br>ESVKGRFTISRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVDGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>291) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>CAGTTATCTCATATATCGGAGGAAATAAATACTATG<br>CAGAGTCCGTGAAGGGCCGGTTCACCATCTCCAGAG<br>ACAATTCCAAGAACACCCTGTATCTGCAAATGAACA<br>GCCTGAGAGCTGAGGACACGGCTCTGTTTTACTGTG<br>CGAGAGGATACGATGTTTTGACTGGTTACCCCGACT<br>ACTGGGGCCAGGGAACCCTGGTCACCGTGTCTAGTG<br>CCTCCACCAAGGGCCCATCGGTCTTCCCCCTGGCACC<br>CTCCTCCAAGAGCACCTCTGGGGGCACAGCGGCCCT<br>GGGCTGCCTGGTCAAGGACTACTTCCCCGAACCGGT<br>GACGGTGTCGTGGAACTCAGGCGCCCTGACCAGCGG<br>CGTGCACACCTTCCCGGCTGTCCTACAGTCCTCAGGA<br>CTCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 372) |
| 122A | HC-151 | QVQLVESGGGVVQPGRSLRLS<br>CAASGFTFSYYAMHWVRQAP<br>GKGLEWVAVISSMGTNKYYA<br>ESVKGRFTISRDNSKNTLYLQ<br>MNSLRAEDTALFYCARGYDV<br>LTGYPDYWGQGTLVTVSSAST | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTTACTACGCCATGCACTGGG<br>TCCGCCAGGCTCCAGGCAAGGGGCTGGAGTGGGTGG<br>CAGTTATCTCATCTATGGGAACTAATAAATACTATGC<br>AGAGTCCGTGAAGGGCCGGTTCACCATCTCCAGAGA |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVKGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>292) | CAATTCCAAGAACACCCTGTATCTGCAAATGAACAG<br>CCTGAGAGCTGAGGACACGGCTCTGTTTTACTGTGC<br>GAGAGGATACGATGTTTTGACTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCAAA<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 373) |
| 122B | HC-152 | QVQLVESGGGVVQPGRSLRLS<br>CAASGFTFSYYAMHWVRQAP<br>GKGLEWVAVISSMGTNKYYA<br>ESVKGRFTISRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVDGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO:<br>293) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTTACTACGCCATGCACTGGG<br>TCCGCCAGGCTCCAGGCAAGGGGCTGGAGTGGGTGG<br>CAGTTATCTCATCTATGGGAACTAATAAATACTATGC<br>AGAGTCCGTGAAGGGCCGGTTCACCATCTCCAGAGA<br>CAATTCCAAGAACACCCTGTATCTGCAAATGAACAG<br>CCTGAGAGCTGAGGACACGGCTCTGTTTTACTGTGC<br>GAGAGGATACGATGTTTTGACTGGTTACCCCGACTA<br>CTGGGGCCAGGGAACCCTGGTCACCGTGTCTAGTGC<br>CTCCACCAAGGGCCCATCGGTCTTCCCCCTGGCACCC<br>TCCTCCAAGAGCACCTCTGGGGGCACAGCGGCCCTG<br>GGCTGCCTGGTCAAGGACTACTTCCCCGAACCGGTG<br>ACGGTGTCGTGGAACTCAGGCGCCCTGACCAGCGGC<br>GTGCACACCTTCCCGGCTGTCCTACAGTCCTCAGGAC<br>TCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 374) |
| 124A | HC-153 | QVQLVESGGGVVQPGRSLRLS<br>CAASGFTFSRFAMHWVRQAP<br>GKGLEWVAVISYNGRNKYYA | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | ESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK (SEQ ID NO: 294) | TCCGCCAGGCTCCAGGCAAGGGGCTGGAGTGGGTGGCAGTTATCTCATATAACGGACGCAATAAATACTATGCAGAGTCCGTGAAGGGCCGGTTCACCATCTCCAGAGACAATTCCAAGAACACCCTGTATCTGCAAATGAACAGCCTGAGAGCTGAGGACACGGCTCTGTTTTACTGTGCGAGAGGATACGATGTTTTGACTGGTTACCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAAGAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACGACACCACGCCTCCCGTGCTGGACTCCGACGGCTCCTTCTTCCTCTATAGCGACCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 375) |
| 124B | HC-154 | QVQLVESGGGVVQPGRSLRLSCAASGFTFSRFAMHWVRQAPGKGLEWVAVISYNGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK (SEQ ID NO: 295) | CAGGTGCAGCTGGTGGAGTCTGGGGGAGGCGTGGTCCAGCCTGGGAGGTCCCTGCGACTCTCCTGTGCAGCCTCTGGATTCACCTTCAGTAGATTTGCCATGCACTGGGTCCGCCAGGCTCCAGGCAAGGGGCTGGAGTGGGTGGCAGTTATCTCATATAACGGACGCAATAAATACTATGCAGAGTCCGTGAAGGGCCGGTTCACCATCTCCAGAGACAATTCCAAGAACACCCTGTATCTGCAAATGAACAGCCTGAGAGCTGAGGACACGGCTCTGTTTTACTGTGCGAGAGGATACGATGTTTTGACTGGTTACCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAAGAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCGATGGCTTCTATCCCAGCGACATCGCCGTGGAGTGGGAGAGCAATGGGCAGCCGGAGAACAACTACGACACCACGCCTCCCGTGCTGGACTCCGACGGCTCCTTCTTCCTCTATAGCGACCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 376) |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| 125A | HC-155 | QVQLVESGGGVVQPGRSLRLS<br>CAASGFTFSRFAMHWVRQAP<br>GKGLEWVAVISYIGRNKYYAE<br>SVKGRFTISRDNSKNTLYLQM<br>NSLRAEDTALFYCARGYDVLT<br>GYPDYWGQGTLVTVSSASTK<br>GPSVFPLAPSSKSTSGGTAALG<br>CLVKDYFPEPVTVSWNSGALT<br>SGVHTFPAVLQSSGLYSLKSV<br>VTVPSSSLGTQTYICNVNHKPS<br>NTKVDKKVEPKSCDKTHTCPP<br>CPAPELLGGPSVFLFPPKPKDT<br>LMISRTPEVTCVVVDVSHEDP<br>EVKFNWYVDGVEVHNAKTKP<br>CEEQYGSTYRCVSVLTVLHQD<br>WLNGKEYKCKVSNKALPAPIE<br>KTISKAKGQPREPQVYTLPPSR<br>EEMTKNQVSLTCLVKGFYPSD<br>IAVEWESNGQPENNYDTTPPV<br>LDSDGSFFLYSDLTVDKSRWQ<br>QGNVFSCSVMHEALHNHYTQ<br>KSLSLSPGK (SEQ ID NO: 296) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>CAGTTATCTCATATATCGGACGCAATAAATACTATG<br>CAGAGTCCGTGAAGGGCCGGTTCACCATCTCCAGAG<br>ACAATTCCAAGAACACCCTGTATCTGCAAATGAACA<br>GCCTGAGAGCTGAGGACACGGCTCTGTTTTACTGTG<br>CGAGAGGATACGATGTTTTGACTGGTTACCCCGACT<br>ACTGGGGCCAGGGAACCCTGGTCACCGTGTCTAGTG<br>CCTCCACCAAGGGCCCATCGGTCTTCCCCCTGGCACC<br>CTCCTCCAAGAGCACCTCTGGGGGCACAGCGGCCCT<br>GGGCTGCCTGGTCAAGGACTACTTCCCCGAACCGGT<br>GACGGTGTCGTGGAACTCAGGCGCCCTGACCAGCGG<br>CGTGCACACCTTCCCGGCTGTCCTACAGTCCTCAGGA<br>CTCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCAAA<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 377) |
| 125B | HC-156 | QVQLVESGGGVVQPGRSLRLS<br>CAASGFTFSRFAMHWVRQAP<br>GKGLEWVAVISYIGRNKYYAE<br>SVKGRFTISRDNSKNTLYLQM<br>NSLRAEDTALFYCARGYDVLT<br>GYPDYWGQGTLVTVSSASTK<br>GPSVFPLAPSSKSTSGGTAALG<br>CLVKDYFPEPVTVSWNSGALT<br>SGVHTFPAVLQSSGLYSLKSV<br>VTVPSSSLGTQTYICNVNHKPS<br>NTKVDKKVEPKSCDKTHTCPP<br>CPAPELLGGPSVFLFPPKPKDT<br>LMISRTPEVTCVVVDVSHEDP<br>EVKFNWYVDGVEVHNAKTKP<br>CEEQYGSTYRCVSVLTVLHQD<br>WLNGKEYKCKVSNKALPAPIE<br>KTISKAKGQPREPQVYTLPPSR<br>EEMTKNQVSLTCLVDGFYPSD<br>IAVEWESNGQPENNYDTTPPV<br>LDSDGSFFLYSDLTVDKSRWQ<br>QGNVFSCSVMHEALHNHYTQ<br>KSLSLSPGK (SEQ ID NO: 297) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>CAGTTATCTCATATATCGGACGCAATAAATACTATG<br>CAGAGTCCGTGAAGGGCCGGTTCACCATCTCCAGAG<br>ACAATTCCAAGAACACCCTGTATCTGCAAATGAACA<br>GCCTGAGAGCTGAGGACACGGCTCTGTTTTACTGTG<br>CGAGAGGATACGATGTTTTGACTGGTTACCCCGACT<br>ACTGGGGCCAGGGAACCCTGGTCACCGTGTCTAGTG<br>CCTCCACCAAGGGCCCATCGGTCTTCCCCCTGGCACC<br>CTCCTCCAAGAGCACCTCTGGGGGCACAGCGGCCCT<br>GGGCTGCCTGGTCAAGGACTACTTCCCCGAACCGGT<br>GACGGTGTCGTGGAACTCAGGCGCCCTGACCAGCGG<br>CGTGCACACCTTCCCGGCTGTCCTACAGTCCTCAGGA<br>CTCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC |

TABLE 7B-continued

| Exemplary Anti-PAC1 Receptor Antibody Heavy Chain Sequences | | | |
|---|---|---|---|
| Antibody ID. | HC Group | Heavy Chain Amino Acid Sequence | Heavy Chain Nucleic Acid Sequence |
| | | | TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 378) |
| 126A | HC-157 | QVQLVESGGGVVQPGRSLRLS CAASGFTFSRFAMHWVRQAP GKGLEWVAVISYNGGNKYYA RSVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 298) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CAGTTATCTCATATAACGGAGGAAATAAATACTATG CACGCTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 379) |
| 126B | HC-158 | QVQLVESGGGVVQPGRSLRLS CAASGFTFSRFAMHWVRQAP GKGLEWVAVISYNGGNKYYA RSVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 299) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CAGTTATCTCATATAACGGAGGAAATAAATACTATG CACGCTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCGAT |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | | GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 380) |
| 127A | HC-159 | QVQLVESGGGVVQPGRSLRLS CAASGFTFSRFAMHWVRQAP GKGLEWVAVISYYGGNKYYA RSVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 300) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CAGTTATCTCATATTACGGAGGAAATAAATACTATG CACGCTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 381) |
| 127B | HC-160 | QVQLVESGGGVVQPGRSLRLS CAASGFTFSRFAMHWVRQAP GKGLEWVAVISYYGGNKYYA RSVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 301) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CAGTTATCTCATATTACGGAGGAAATAAATACTATG CACGCTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA |

TABLE 7B-continued

| Exemplary Anti-PAC1 Receptor Antibody Heavy Chain Sequences | | | |
|---|---|---|---|
| Antibody ID. | HC Group | Heavy Chain Amino Acid Sequence | Heavy Chain Nucleic Acid Sequence |
| | | | ACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCGATGGCTTCTATCCCAGCGACATCGCCGTGGAGTGGGAGAGCAATGGGCAGCCGGAGAACAACTACGACACCACGCCTCCCGTGCTGGACTCCGACGGCTCCTTCTTCCTCTATAGCGACCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 382) |
| 128A | HC-161 | QVQLVESGGGVVQPGRSLRLSCAASGFTFSRFAMHWVRQAPGKGLEWVAVISYQGRNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK (SEQ ID NO: 302) | CAGGTGCAGCTGGTGGAGTCTGGGGGAGGCGTGGTCCAGCCTGGGAGGTCCCTGCGACTCTCCTGTGCAGCCTCTGGATTCACCTTCAGTAGATTTGCCATGCACTGGGTCCGCCAGGCTCCAGGCAAGGGGCTGGAGTGGGTGGCAGTTATCTCATATCAGGGACGCAATAAATACTATGCACGCTCCGTGAAGGGCCGGTTCACCATCTCCAGAGACAATTCCAAGAACACCCTGTATCTGCAAATGAACAGCCTGAGAGCTGAGGACACGGCTCTGTTTTACTGTGCGAGAGGATACGATGTTTTGACTGGTTACCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAAGAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACGACACCACGCCTCCCGTGCTGGACTCCGACGGCTCCTTCTTCCTCTATAGCGACCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 383) |
| 128B | HC-162 | QVQLVESGGGVVQPGRSLRLSCAASGFTFSRFAMHWVRQAPGKGLEWVAVISYQGRNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK (SEQ ID NO: 303) | CAGGTGCAGCTGGTGGAGTCTGGGGGAGGCGTGGTCCAGCCTGGGAGGTCCCTGCGACTCTCCTGTGCAGCCTCTGGATTCACCTTCAGTAGATTTGCCATGCACTGGGTCCGCCAGGCTCCAGGCAAGGGGCTGGAGTGGGTGGCAGTTATCTCATATCAGGGACGCAATAAATACTATGCACGCTCCGTGAAGGGCCGGTTCACCATCTCCAGAGACAATTCCAAGAACACCCTGTATCTGCAAATGAACAGCCTGAGAGCTGAGGACACGGCTCTGTTTTACTGTGCGAGAGGATACGATGTTTTGACTGGTTACCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAAGAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGC |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | | ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 384) |
| 129A | HC-163 | QVQLVESGGGVVQPGRSLRLS<br>CAASGFTFSRFAMHWVRQAP<br>GKGLEWVAVISYYGRNKYYA<br>RSVKGRFTISRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVKGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO: 304) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>CAGTTATCTCATATTACGGACGCAATAAATACTATG<br>CACGCTCCGTGAAGGGCCGGTTCACCATCTCCAGAG<br>ACAATTCCAAGAACACCCTGTATCTGCAAATGAACA<br>GCCTGAGAGCTGAGGACACGGCTCTGTTTTACTGTG<br>CGAGAGGATACGATGTTTTGACTGGTTACCCCGACT<br>ACTGGGGCCAGGGAACCCTGGTCACCGTGTCTAGTG<br>CCTCCACCAAGGGCCCATCGGTCTTCCCCCTGGCACC<br>CTCCTCCAAGAGCACCTCTGGGGGCACAGCGGCCCT<br>GGGCTGCCTGGTCAAGGACTACTTCCCCGAACCGGT<br>GACGGTGTCGTGGAACTCAGGCGCCCTGACCAGCGG<br>CGTGCACACCTTCCCGGCTGTCCTACAGTCCTCAGGA<br>CTCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCAAA<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 385) |
| 129B | HC-164 | QVQLVESGGGVVQPGRSLRLS<br>CAASGFTFSRFAMHWVRQAP<br>GKGLEWVAVISYYGRNKYYA<br>RSVKGRFTISRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVDGFY | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>CAGTTATCTCATATTACGGACGCAATAAATACTATG<br>CACGCTCCGTGAAGGGCCGGTTCACCATCTCCAGAG<br>ACAATTCCAAGAACACCCTGTATCTGCAAATGAACA<br>GCCTGAGAGCTGAGGACACGGCTCTGTTTTACTGTG<br>CGAGAGGATACGATGTTTTGACTGGTTACCCCGACT<br>ACTGGGGCCAGGGAACCCTGGTCACCGTGTCTAGTG<br>CCTCCACCAAGGGCCCATCGGTCTTCCCCCTGGCACC<br>CTCCTCCAAGAGCACCTCTGGGGGCACAGCGGCCCT<br>GGGCTGCCTGGTCAAGGACTACTTCCCCGAACCGGT<br>GACGGTGTCGTGGAACTCAGGCGCCCTGACCAGCGG<br>CGTGCACACCTTCCCGGCTGTCCTACAGTCCTCAGGA<br>CTCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | PSDIAVEWESNGQPENNYDTT PPVLDSDGSFFLYSDLTVDKSR WQQGNVFSCSVMHEALHNHY TQKSLSLSPGK (SEQ ID NO: 305) | GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCGAT GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 386) |
| 130A | HC-165 | QVQLVESGGGVVQPGRSLRLS CAASGFTFSRFAMHWVRQAP GKGLEWVAVISYNGNNKYYA RSVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 306) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CAGTTATCTCATATAACGGAAACAATAAATACTATG CACGCTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 387) |
| 130B | HC-166 | QVQLVESGGGVVQPGRSLRLS CAASGFTFSRFAMHWVRQAP GKGLEWVAVISYNGNNKYYA RSVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CAGTTATCTCATATAACGGAAACAATAAATACTATG CACGCTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA |

TABLE 7B-continued

| Exemplary Anti-PAC1 Receptor Antibody Heavy Chain Sequences | | | |
|---|---|---|---|
| Antibody ID. | HC Group | Heavy Chain Amino Acid Sequence | Heavy Chain Nucleic Acid Sequence |
| | | QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 307) | CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCGAT GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 388) |
| 131A | HC-167 | QVQLVESGGGVVQPGRSLRLS CAASGFTFSRFAMHWVRQAP GKGLEWVAVISYNGRNKYYA RSVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVKGFY PSDIAVEWESNGQPENNYDTT PPVLDSDGSFFLYSDLTVDKSR WQQGNVFSCSVMHEALHNHY TQKSLSLSPGK (SEQ ID NO: 308) | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CAGTTATCTCATATAACGGACGCAATAAATACTATG CACGCTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCAAA GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 389) |
| 131B | HC-168 | QVQLVESGGGVVQPGRSLRLS CAASGFTFSRFAMHWVRQAP GKGLEWVAVISYNGRNKYYA RSVKGRFTISRDNSKNTLYLQ MNSLRAEDTALFYCARGYDV LTGYPDYWGQGTLVTVSSAST KGPSVFPLAPSSKSTSGGTAAL GCLVKDYFPEPVTVSWNSGAL TSGVHTFPAVLQSSGLYSLKS VVTVPSSSLGTQTYICNVNHK PSNTKVDKKVEPKSCDKTHTC PPCPAPELLGGPSVFLFPPKPK | CAGGTGCAGCTGGTGGAGTCTGGGGGAGGCGTGGTC CAGCCTGGGAGGTCCCTGCGACTCTCCTGTGCAGCC TCTGGATTCACCTTCAGTAGATTTGCCATGCACTGGG TCCGCCAGGCTCCAGGCAAGGGGCTGGAGTGGGTGG CAGTTATCTCATATAACGGACGCAATAAATACTATG CACGCTCCGTGAAGGGCCGGTTCACCATCTCCAGAG ACAATTCCAAGAACACCCTGTATCTGCAAATGAACA GCCTGAGAGCTGAGGACACGGCTCTGTTTTACTGTG CGAGAGGATACGATGTTTTGACTGGTTACCCCGACT ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVDGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO: 309) | GGGCTGCCTGGTCAAGGACTACTTCCCCGAACCGGT<br>GACGGTGTCGTGGAACTCAGGCGCCCTGACCAGCGG<br>CGTGCACACCTTCCCGGCTGTCCTACAGTCCTCAGGA<br>CTCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCGAT<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 390) |
| 132A | HC-169 | QVQLVESGGGVVQPGRSLRLS<br>CAASGFTFSRFAMHWVRQAP<br>GKGLEWVAVISYIGRNKYYA<br>RSVKGRFTISRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS<br>VVTVPSSSLGTQTYICNVNHK<br>PSNTKVDKKVEPKSCDKTHTC<br>PPCPAPELLGGPSVFLFPPKPK<br>DTLMISRTPEVTCVVVDVSHE<br>DPEVKFNWYVDGVEVHNAKT<br>KPCEEQYGSTYRCVSVLTVLH<br>QDWLNGKEYKCKVSNKALPA<br>PIEKTISKAKGQPREPQVYTLP<br>PSREEMTKNQVSLTCLVKGFY<br>PSDIAVEWESNGQPENNYDTT<br>PPVLDSDGSFFLYSDLTVDKSR<br>WQQGNVFSCSVMHEALHNHY<br>TQKSLSLSPGK (SEQ ID NO: 310) | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>CAGTTATCTCATATATCGGACGCAATAAATACTATG<br>CACGCTCCGTGAAGGGCCGGTTCACCATCTCCAGAG<br>ACAATTCCAAGAACACCCTGTATCTGCAAATGAACA<br>GCCTGAGAGCTGAGGACACGGCTCTGTTTTACTGTG<br>CGAGAGGATACGATGTTTTGACTGGTTACCCCGACT<br>ACTGGGGCCAGGGAACCCTGGTCACCGTGTCTAGTG<br>CCTCCACCAAGGGCCCATCGGTCTTCCCCCTGGCACC<br>CTCCTCCAAGAGCACCTCTGGGGGCACAGCGGCCCT<br>GGGCTGCCTGGTCAAGGACTACTTCCCCGAACCGGT<br>GACGGTGTCGTGGAACTCAGGCGCCCTGACCAGCGG<br>CGTGCACACCTTCCCGGCTGTCCTACAGTCCTCAGGA<br>CTCTACTCCCTCAAGAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGG<br>TGGTGGACGTGAGCCACGAAGACCCTGAGGTCAAGT<br>TCAACTGGTACGTGGACGGCGTGGAGGTGCATAATG<br>CCAAGACAAAGCCGTGCGAGGAGCAGTACGGCAGC<br>ACGTACCGTTGCGTCAGCGTCCTCACCGTCCTGCACC<br>AGGACTGGCTGAATGGCAAGGAGTACAAGTGCAAG<br>GTGTCCAACAAAGCCCTCCCAGCCCCCATCGAGAAA<br>ACCATCTCCAAAGCCAAAGGGCAGCCCCGAGAACCA<br>CAGGTGTACACCCTGCCCCCATCCCGGGAGGAGATG<br>ACCAAGAACCAGGTCAGCCTGACCTGCCTGGTCAAA<br>GGCTTCTATCCCAGCGACATCGCCGTGGAGTGGGAG<br>AGCAATGGGCAGCCGGAGAACAACTACGACACCAC<br>GCCTCCCGTGCTGGACTCCGACGGCTCCTTCTTCCTC<br>TATAGCGACCTCACCGTGGACAAGAGCAGGTGGCAG<br>CAGGGGAACGTCTTCTCATGCTCCGTGATGCATGAG<br>GCTCTGCACAACCACTACACGCAGAAGAGCCTCTCC<br>CTGTCTCCGGGTAAA (SEQ ID NO: 391) |
| 132B | HC-170 | QVQLVESGGGVVQPGRSLRLS<br>CAASGFTFSRFAMHWVRQAP<br>GKGLEWVAVISYIGRNKYYA<br>RSVKGRFTISRDNSKNTLYLQ<br>MNSLRAEDTALFYCARGYDV<br>LTGYPDYWGQGTLVTVSSAST<br>KGPSVFPLAPSSKSTSGGTAAL<br>GCLVKDYFPEPVTVSWNSGAL<br>TSGVHTFPAVLQSSGLYSLKS | CAGGTGCAGCTGGTGGAGTCTGGGGGAGGCGTGGTC<br>CAGCCTGGGAGGTCCCTGCGACTCTCCTGTGCAGCC<br>TCTGGATTCACCTTCAGTAGATTTGCCATGCACTGGG<br>TCCGCCAGGCTCCAGGCAAGGGGCTGGAGTGGGTGG<br>CAGTTATCTCATATATCGGACGCAATAAATACTATG<br>CACGCTCCGTGAAGGGCCGGTTCACCATCTCCAGAG<br>ACAATTCCAAGAACACCCTGTATCTGCAAATGAACA<br>GCCTGAGAGCTGAGGACACGGCTCTGTTTTACTGTG<br>CGAGAGGATACGATGTTTTGACTGGTTACCCCGACT |

TABLE 7B-continued

Exemplary Anti-PAC1 Receptor Antibody Heavy Chain Sequences

| Antibody ID. | HC Group | Heavy Chain Amino Acid Sequence | Heavy Chain Nucleic Acid Sequence |
|---|---|---|---|
| | | VVTVPSSSLGTQTYICNVNHK PSNTKVDKKVEPKSCDKTHTC PPCPAPELLGGPSVFLFPPKPK DTLMISRTPEVTCVVVDVSHE DPEVKFNWYVDGVEVHNAKT KPCEEQYGSTYRCVSVLTVLH QDWLNGKEYKCKVSNKALPA PIEKTISKAKGQPREPQVYTLP PSREEMTKNQVSLTCLVDGFY PSDIAVEWESNGQPENNYDTT PPVLDSDGSFFLYSDLTVDKSR WQQGNVFSCSVMHEALHNHY TQKSLSLSPGK (SEQ ID NO: 311) | ACTGGGGCCAGGGAACCCTGGTCACCGTGTCTAGTG CCTCCACCAAGGGCCCATCGGTCTTCCCCCTGGCACC CTCCTCCAAGAGCACCTCTGGGGGCACAGCGGCCCT GGGCTGCCTGGTCAAGGACTACTTCCCCGAACCGGT GACGGTGTCGTGGAACTCAGGCGCCCTGACCAGCGG CGTGCACACCTTCCCGGCTGTCCTACAGTCCTCAGGA CTCTACTCCCTCAAGAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGG TGGTGGACGTGAGCCACGAAGACCCTGAGGTCAAGT TCAACTGGTACGTGGACGGCGTGGAGGTGCATAATG CCAAGACAAAGCCGTGCGAGGAGCAGTACGGCAGC ACGTACCGTTGCGTCAGCGTCCTCACCGTCCTGCACC AGGACTGGCTGAATGGCAAGGAGTACAAGTGCAAG GTGTCCAACAAAGCCCTCCCAGCCCCCATCGAGAAA ACCATCTCCAAAGCCAAAGGGCAGCCCCGAGAACCA CAGGTGTACACCCTGCCCCCATCCCGGGAGGAGATG ACCAAGAACCAGGTCAGCCTGACCTGCCTGGTCGAT GGCTTCTATCCCAGCGACATCGCCGTGGAGTGGGAG AGCAATGGGCAGCCGGAGAACAACTACGACACCAC GCCTCCCGTGCTGGACTCCGACGGCTCCTTCTTCCTC TATAGCGACCTCACCGTGGACAAGAGCAGGTGGCAG CAGGGGAACGTCTTCTCATGCTCCGTGATGCATGAG GCTCTGCACAACCACTACACGCAGAAGAGCCTCTCC CTGTCTCCGGGTAAA (SEQ ID NO: 392) |

In some embodiments, the heterodimeric antibody of the invention comprises an anti-PAC1 receptor antibody light chain from Table 7A and an anti-PAC1 receptor antibody heavy chain from Table 7B. Exemplary pairs of anti-PAC1 receptor antibody light and heavy chains that may be incorporated into a heterodimeric antibody of the invention include, but are not limited to: LC-102 (SEQ ID NO: 232) and HC-102 (SEQ ID NO: 243); LC-102 (SEQ ID NO: 232) and HC-103 (SEQ ID NO: 244); LC-102 (SEQ ID NO: 232) and HC-104 (SEQ ID NO: 245); LC-102 (SEQ ID NO: 232) and HC-105 (SEQ ID NO: 246); LC-102 (SEQ ID NO: 232) and HC-106 (SEQ ID NO: 247); LC-102 (SEQ ID NO: 232) and HC-107 (SEQ ID NO: 248); LC-102 (SEQ ID NO: 232) and HC-108 (SEQ ID NO: 249); LC-102 (SEQ ID NO: 232) and HC-109 (SEQ ID NO: 250); LC-102 (SEQ ID NO: 232) and HC-110 (SEQ ID NO: 251); LC-102 (SEQ ID NO: 232) and HC-111 (SEQ ID NO: 252); LC-102 (SEQ ID NO: 232) and HC-112 (SEQ ID NO: 253); LC-102 (SEQ ID NO: 232) and HC-149 (SEQ ID NO: 290); LC-102 (SEQ ID NO: 232) and HC-150 (SEQ ID NO: 291); LC-102 (SEQ ID NO: 232) and HC-153 (SEQ ID NO: 294); LC-102 (SEQ ID NO: 232) and HC-154 (SEQ ID NO: 295); LC-102 (SEQ ID NO: 232) and HC-155 (SEQ ID NO: 296); LC-102 (SEQ ID NO: 232) and HC-156 (SEQ ID NO: 297); LC-102 (SEQ ID NO: 232) and HC-157 (SEQ ID NO: 298); LC-102 (SEQ ID NO: 232) and HC-158 (SEQ ID NO: 299); LC-102 (SEQ ID NO: 232) and HC-159 (SEQ ID NO: 300); LC-102 (SEQ ID NO: 232) and HC-160 (SEQ ID NO: 301); LC-102 (SEQ ID NO: 232) and HC-167 (SEQ ID NO: 308); LC-102 (SEQ ID NO: 232) and HC-168 (SEQ ID NO: 309); LC-102 (SEQ ID NO: 232) and HC-169 (SEQ ID NO: 310); LC-102 (SEQ ID NO: 232) and HC-170 (SEQ ID NO: 311); LC-103 (SEQ ID NO: 233) and HC-113 (SEQ ID NO: 254); LC-103 (SEQ ID NO: 233) and HC-114 (SEQ ID NO: 255); LC-103 (SEQ ID NO: 233) and HC-115 (SEQ ID NO: 256); LC-103 (SEQ ID NO: 233) and HC-116 (SEQ ID NO: 257); LC-103 (SEQ ID NO: 233) and HC-117 (SEQ ID NO: 258); LC-103 (SEQ ID NO: 233) and HC-118 (SEQ ID NO: 259); LC-103 (SEQ ID NO: 233) and HC-119 (SEQ ID NO: 260); LC-103 (SEQ ID NO: 233) and HC-120 (SEQ ID NO: 261); LC-103 (SEQ ID NO: 233) and HC-121 (SEQ ID NO: 262); LC-103 (SEQ ID NO: 233) and HC-122 (SEQ ID NO: 263); LC-103 (SEQ ID NO: 233) and HC-125 (SEQ ID NO: 266); LC-103 (SEQ ID NO: 233) and HC-126 (SEQ ID NO: 267); LC-103 (SEQ ID NO: 233) and HC-127 (SEQ ID NO: 268); LC-103 (SEQ ID NO: 233) and HC-128 (SEQ ID NO: 269); LC-103 (SEQ ID NO: 233) and HC-129 (SEQ ID NO: 270); LC-103 (SEQ ID NO: 233) and HC-130 (SEQ ID NO: 271); LC-103 (SEQ ID NO: 233) and HC-139 (SEQ ID NO: 280); LC-103 (SEQ ID NO: 233) and HC-140 (SEQ ID NO: 281); LC-104 (SEQ ID NO: 234) and HC-123 (SEQ ID NO: 264); LC-104 (SEQ ID NO: 234) and HC-124 (SEQ ID NO: 265); LC-105 (SEQ ID NO: 235) and HC-131 (SEQ ID NO: 272); LC-105 (SEQ ID NO: 235) and HC-132 (SEQ ID NO: 273); LC-106 (SEQ ID NO: 236) and HC-133 (SEQ ID NO: 274); LC-106 (SEQ ID NO: 236) and HC-134 (SEQ ID NO: 275); LC-106 (SEQ ID NO: 236) and HC-135 (SEQ ID NO: 276); LC-106 (SEQ ID NO: 236) and HC-136 (SEQ ID NO: 277); LC-106 (SEQ ID NO: 236) and HC-141 (SEQ ID NO: 282); LC-106 (SEQ ID NO: 236) and HC-142 (SEQ ID NO: 283); LC-106 (SEQ ID NO: 236) and HC-143 (SEQ ID NO: 284); LC-106 (SEQ ID NO: 236) and HC-144 (SEQ ID NO: 285); LC-106 (SEQ ID NO: 236) and HC-145 (SEQ ID NO: 286); LC-106 (SEQ ID NO: 236) and HC-146 (SEQ ID NO: 287); LC-107 (SEQ ID NO: 237)

and HC-137 (SEQ ID NO: 278); LC-107 (SEQ ID NO: 237) and HC-138 (SEQ ID NO: 279); LC-108 (SEQ ID NO: 238) and HC-147 (SEQ ID NO: 288); LC-108 (SEQ ID NO: 238) and HC-148 (SEQ ID NO: 289); LC-109 (SEQ ID NO: 239) and HC-149 (SEQ ID NO: 290); LC-109 (SEQ ID NO: 239) and HC-150 (SEQ ID NO: 291); LC-110 (SEQ ID NO: 240) and HC-151 (SEQ ID NO: 292); LC-110 (SEQ ID NO: 240) and HC-152 (SEQ ID NO: 293); LC-111 (SEQ ID NO: 241) and HC-161 (SEQ ID NO: 302); LC-111 (SEQ ID NO: 241) and HC-162 (SEQ ID NO: 303); LC-111 (SEQ ID NO: 241) and HC-163 (SEQ ID NO: 304); LC-111 (SEQ ID NO: 241) and HC-164 (SEQ ID NO: 305); LC-111 (SEQ ID NO: 241) and HC-165 (SEQ ID NO: 306); and LC-111 (SEQ ID NO: 241) and HC-166 (SEQ ID NO: 307).

In certain embodiments, the heterodimeric antibody of the invention comprises an anti-PAC1 receptor antibody light chain comprising the sequence of SEQ ID NO: 232 and an anti-PAC1 receptor antibody heavy chain comprising a sequence selected from SEQ ID NOs: 243-253, 290, 291, 294, and 295. In other embodiments, the heterodimeric antibody of the invention comprises an anti-PAC1 receptor antibody light chain comprising the sequence of SEQ ID NO: 233 and an anti-PAC1 receptor antibody heavy chain comprising a sequence selected from SEQ ID NOs: 256, 257, 260, 261, and 268-271. In yet other embodiments, the heterodimeric antibody of the invention comprises an anti-PAC1 receptor antibody light chain comprising the sequence of SEQ ID NO: 234 and an anti-PAC1 receptor antibody heavy chain comprising the sequence of SEQ ID NO: 264 or SEQ ID NO: 265. In still other embodiments, the heterodimeric antibody of the invention comprises an anti-PAC1 receptor antibody light chain comprising the sequence of SEQ ID NO: 236 and an anti-PAC1 receptor antibody heavy chain comprising the sequence of SEQ ID NO: 274 or SEQ ID NO: 275.

The anti-PAC1 receptor antibody light chain and/or heavy chain incorporated into a heterodimeric antibody of the invention may comprise a sequence of contiguous amino acids that differs from the sequence of a light chain in Table 7A or a heavy chain in Table 7B by 1, 2, 3, 4, 5, 6, 7, 8, 9, 10, 11, 12, 13, 14, 15 or more amino acid residues, wherein each such sequence difference is independently a deletion, insertion or substitution of one amino acid. In some embodiments, the anti-PAC1 receptor antibody light chain incorporated into a heterodimeric antibody of the invention comprises a sequence of amino acids that has at least 70%, at least 75%, at least 80%, at least 85%, at least 90%, at least 95%, at least 97% or at least 99% sequence identity to the amino acid sequences of SEQ ID NOs: 231-241 (i.e. the anti-PAC1 receptor antibody light chains in Table 7A). In one embodiment, a heterodimeric antibody of the invention comprises an anti-PAC1 receptor antibody light chain that comprises a sequence that is at least 90% identical to a sequence selected from SEQ ID NOs: 232-241. In another embodiment, a heterodimeric antibody of the invention comprises an anti-PAC1 receptor antibody light chain that comprises a sequence that is at least 95% identical to a sequence selected from SEQ ID NOs: 232-241. In certain embodiments, the anti-PAC1 receptor antibody heavy chain incorporated into a heterodimeric antibody of the invention comprises a sequence of amino acids that has at least 70%, at least 75%, at least 80%, at least 85%, at least 90%, at least 95%, at least 97% or at least 99% sequence identity to the amino acid sequences of SEQ ID NOs: 242-311 (i.e. the anti-PAC1 receptor antibody heavy chains in Table 7B). In one embodiment, a heterodimeric antibody of the invention comprises an anti-PAC1 receptor antibody heavy chain that comprises a sequence that is at least 90% identical to a sequence selected from SEQ ID NOs: 243-311. In another embodiment, a heterodimeric antibody of the invention comprises an anti-PAC1 receptor antibody heavy chain that comprises a sequence that is at least 95% identical to a sequence selected from SEQ ID NOs: 243-311.

Any of the anti-CGRP receptor antibody light and heavy chains listed in Tables 5A and 5B may be combined with any of the anti-PAC1 receptor antibody light and heavy chains listed in Tables 7A and 7B to form a bispecific, heterodimeric antibody of the invention. The structural features (e.g. component anti-CGRP receptor antibody light and heavy chains and anti-PAC1 receptor antibody light and heavy chains) of exemplary bispecific, heterodimeric antibodies of the invention are set forth in Table 8 below. These antibodies contain one or more charge pair mutations as described herein to promote correct pairing of heavy and light chains as well as heterodimerization between an anti-CGRP receptor antibody heavy chain and an anti-PAC1 receptor heavy chain. Antibodies having an “A” or “E” designation comprise mutations in the light and heavy chain constant regions according to the “v101” electrostatic steering strategy shown in FIG. 2, whereas antibodies having a “B” designation comprise mutations in the light and heavy chain constant regions according to the “v103” electrostatic steering strategy shown in FIG. 2. Antibodies having a “C” or “F” designation comprise mutations in the light and heavy chain constant regions according to the “v102” electrostatic steering strategy shown in FIG. 2, whereas antibodies having a “D” or “G” designation comprise mutations in the light and heavy chain constant regions according to the “v104” electrostatic steering strategy shown in FIG. 2. Antibodies having an “E,” “F,” or “G” designation additionally comprise M252Y, S254T, and T256E mutations in the CH2 domains of the heavy chains to enhance circulation half-life by increasing the affinity of the molecules for the FcRn receptor. The variable light and heavy chain designations (e.g. LV-01, LV-02, LV-101, LV-102, HV-01, HV-02, HV-101, HV-102, etc.) in Table 8 are defined by amino acid sequence in Tables 2A, 2B, 6A, and 6B and nucleotide sequence in Tables 9 and 10. The light and heavy chain designations (e.g. LC-01, LC-02, LC-101, LC-102, HC-01, HC-02, HC-101, HC-102, etc.) in Table 8 are defined by amino acid and nucleotide sequence in Tables 5A, 5B, 7A, and 7B. Thus, the full sequence information for each of the four chains of the exemplary heterodimeric antibodies in Table 8 can be obtained by cross-reference to these tables. By way of illustration, heterodimeric antibody iPS:454537 comprises an anti-CGRP receptor antibody light chain comprising the amino acid sequence of SEQ ID NO: 72 (LC-04), an anti-CGRP receptor antibody heavy chain comprising the amino acid sequence of SEQ ID NO: 87 (HC-03), an anti-PAC1 receptor antibody light chain comprising the amino acid sequence of SEQ ID NO: 236 (LC-106), and an anti-PAC1 receptor antibody heavy chain comprising the amino acid sequence of SEQ ID NO: 274 (HC-133).

TABLE 8

Exemplary Anti-CGRP Receptor/Anti-PACI Receptor Heterodimeric Antibodies

| Heterodimeric Antibody Designation | Anti-CGRP Receptor Antibody ID. | Anti-CGRP Receptor Ab Full Light Chain | Anti-CGRP Receptor Ab VL | Anti-CGRP Receptor Ab Full Heavy Chain | Anti-CGRP Receptor Ab VH | Anti-PAC1 Receptor Antibody ID. | Anti-PAC1 Receptor Ab Full Light Chain | Anti-PAC1 Receptor Ab VL | Anti-PAC1 Receptor Ab Full Heavy Chain | Anti-PAC1 Receptor Ab VH |
|---|---|---|---|---|---|---|---|---|---|---|
| iPS:454537 | 01A | LC-04 | LV-03 | HC-03 | HV-02 | 113A | LC-106 | LV-106 | HC-133 | HV-114 |
| iPS:454539 | 01A | LC-04 | LV-03 | HC-03 | HV-02 | 122A | LC-110 | LV-110 | HC-151 | HV-123 |
| iPS:454541 | 01A | LC-04 | LV-03 | HC-03 | HV-02 | 115A | LC-107 | LV-107 | HC-137 | HV-116 |
| iPS:454543 | 01A | LC-04 | LV-03 | HC-03 | HV-02 | 118A | LC-106 | LV-106 | HC-143 | HV-119 |
| iPS:454545 | 01A | LC-04 | LV-03 | HC-03 | HV-02 | 119A | LC-106 | LV-106 | HC-145 | HV-120 |
| iPS:454547 | 01A | LC-04 | LV-03 | HC-03 | HV-02 | 109A | LC-103 | LV-103 | HC-125 | HV-110 |
| iPS:454549 | 01A | LC-04 | LV-03 | HC-03 | HV-02 | 114A | LC-106 | LV-106 | HC-135 | HV-115 |
| iPS:454551 | 01A | LC-04 | LV-03 | HC-03 | HV-02 | 117A | LC-106 | LV-106 | HC-141 | HV-118 |
| iPS:454553 | 01A | LC-04 | LV-03 | HC-03 | HV-02 | 120A | LC-108 | LV-108 | HC-147 | HV-121 |
| iPS:454555 | 01A | LC-04 | LV-03 | HC-03 | HV-02 | 121A | LC-109 | LV-109 | HC-149 | HV-122 |
| iPS:454557 (5601) | 01A | LC-04 | LV-03 | HC-03 | HV-02 | 102A | LC-102 | LV-102 | HC-109 | HV-103 |
| iPS:454559 | 01A | LC-04 | LV-03 | HC-03 | HV-02 | 123A | LC-102 | LV-102 | HC-149 | HV-122 |
| iPS:454561 | 01A | LC-04 | LV-03 | HC-03 | HV-02 | 124A | LC-102 | LV-102 | HC-153 | HV-124 |
| iPS:454563 | 01A | LC-04 | LV-03 | HC-03 | HV-02 | 125A | LC-102 | LV-102 | HC-155 | HV-125 |
| iPS:454565 (5606) | 01A | LC-04 | LV-03 | HC-03 | HV-02 | 101A | LC-102 | LV-102 | HC-102 | HV-102 |
| iPS:454567 | 01A | LC-04 | LV-03 | HC-03 | HV-02 | 126A | LC-102 | LV-102 | HC-157 | HV-126 |
| iPS:454569 | 01A | LC-04 | LV-03 | HC-03 | HV-02 | 127A | LC-102 | LV-102 | HC-159 | HV-127 |
| iPS:454571 | 01A | LC-04 | LV-03 | HC-03 | HV-02 | 128A | LC-111 | LV-111 | HC-161 | HV-128 |
| iPS:454573 | 01A | LC-04 | LV-03 | HC-03 | HV-02 | 129A | LC-111 | LV-111 | HC-163 | HV-129 |
| iPS:454575 | 01A | LC-04 | LV-03 | HC-03 | HV-02 | 130A | LC-111 | LV-111 | HC-165 | HV-130 |
| iPS:454577 | 01A | LC-04 | LV-03 | HC-03 | HV-02 | 131A | LC-102 | LV-102 | HC-167 | HV-131 |
| iPS:454579 | 01A | LC-04 | LV-03 | HC-03 | HV-02 | 132A | LC-102 | LV-102 | HC-169 | HV-132 |
| iPS:454581 | 01A | LC-04 | LV-03 | HC-03 | HV-02 | 112A | LC-105 | LV-105 | HC-131 | HV-113 |
| iPS:454583 | 01A | LC-04 | LV-03 | HC-03 | HV-02 | 106A | LC-103 | LV-103 | HC-119 | HV-107 |
| iPS:454585 | 01A | LC-04 | LV-03 | HC-03 | HV-02 | 105A | LC-103 | LV-103 | HC-117 | HV-106 |
| iPS:454587 | 01A | LC-04 | LV-03 | HC-03 | HV-02 | 111A | LC-103 | LV-103 | HC-129 | HV-112 |
| iPS:454589 | 01A | LC-04 | LV-03 | HC-03 | HV-02 | 103A | LC-103 | LV-103 | HC-113 | HV-104 |
| iPS:454591 | 01A | LC-04 | LV-03 | HC-03 | HV-02 | 107A | LC-103 | LV-103 | HC-121 | HV-108 |
| iPS:454593 | 01A | LC-04 | LV-03 | HC-03 | HV-02 | 116A | LC-103 | LV-103 | HC-139 | HV-117 |
| iPS:454595 | 01A | LC-04 | LV-03 | HC-03 | HV-02 | 104A | LC-103 | LV-103 | HC-115 | HV-105 |
| iPS:454597 | 01A | LC-04 | LV-03 | HC-03 | HV-02 | 110A | LC-103 | LV-103 | HC-127 | HV-111 |
| iPS:454599 | 01A | LC-04 | LV-03 | HC-03 | HV-02 | 108A | LC-104 | LV-104 | HC-123 | HV-109 |
| iPS:454601 | 02A | LC-06 | LV-04 | HC-03 | HV-02 | 113A | LC-106 | LV-106 | HC-133 | HV-114 |
| iPS:454603 | 02A | LC-06 | LV-04 | HC-03 | HV-02 | 122A | LC-110 | LV-110 | HC-151 | HV-123 |
| iPS:454605 | 02A | LC-06 | LV-04 | HC-03 | HV-02 | 115A | LC-107 | LV-107 | HC-137 | HV-116 |
| iPS:454607 | 02A | LC-06 | LV-04 | HC-03 | HV-02 | 118A | LC-106 | LV-106 | HC-143 | HV-119 |
| iPS:454609 | 02A | LC-06 | LV-04 | HC-03 | HV-02 | 119A | LC-106 | LV-106 | HC-145 | HV-120 |
| iPS:454611 | 02A | LC-06 | LV-04 | HC-03 | HV-02 | 109A | LC-103 | LV-103 | HC-125 | HV-110 |
| iPS:454613 | 02A | LC-06 | LV-04 | HC-03 | HV-02 | 114A | LC-106 | LV-106 | HC-135 | HV-115 |
| iPS:454615 | 02A | LC-06 | LV-04 | HC-03 | HV-02 | 117A | LC-106 | LV-106 | HC-141 | HV-118 |
| iPS:454617 | 02A | LC-06 | LV-04 | HC-03 | HV-02 | 120A | LC-108 | LV-108 | HC-147 | HV-121 |
| iPS:454619 | 02A | LC-06 | LV-04 | HC-03 | HV-02 | 121A | LC-109 | LV-109 | HC-149 | HV-122 |
| iPS:454621 | 02A | LC-06 | LV-04 | HC-03 | HV-02 | 102A | LC-102 | LV-102 | HC-109 | HV-103 |
| iPS:454623 | 02A | LC-06 | LV-04 | HC-03 | HV-02 | 123A | LC-102 | LV-102 | HC-149 | HV-122 |
| iPS:454625 | 02A | LC-06 | LV-04 | HC-03 | HV-02 | 124A | LC-102 | LV-102 | HC-153 | HV-124 |
| iPS:454627 | 02A | LC-06 | LV-04 | HC-03 | HV-02 | 125A | LC-102 | LV-102 | HC-155 | HV-125 |
| iPS:454629 | 02A | LC-06 | LV-04 | HC-03 | HV-02 | 101A | LC-102 | LV-102 | HC-102 | HV-102 |
| iPS:454631 | 02A | LC-06 | LV-04 | HC-03 | HV-02 | 126A | LC-102 | LV-102 | HC-157 | HV-126 |
| iPS:454633 | 02A | LC-06 | LV-04 | HC-03 | HV-02 | 127A | LC-102 | LV-102 | HC-159 | HV-127 |
| iPS:454635 | 02A | LC-06 | LV-04 | HC-03 | HV-02 | 128A | LC-111 | LV-111 | HC-161 | HV-128 |
| iPS:454637 | 02A | LC-06 | LV-04 | HC-03 | HV-02 | 129A | LC-111 | LV-111 | HC-163 | HV-129 |
| iPS:454639 | 02A | LC-06 | LV-04 | HC-03 | HV-02 | 130A | LC-111 | LV-111 | HC-165 | HV-130 |
| iPS:454641 | 02A | LC-06 | LV-04 | HC-03 | HV-02 | 131A | LC-102 | LV-102 | HC-167 | HV-131 |
| iPS:454643 | 02A | LC-06 | LV-04 | HC-03 | HV-02 | 132A | LC-102 | LV-102 | HC-169 | HV-132 |
| iPS:454645 | 02A | LC-06 | LV-04 | HC-03 | HV-02 | 112A | LC-105 | LV-105 | HC-131 | HV-113 |
| iPS:454647 | 02A | LC-06 | LV-04 | HC-03 | HV-02 | 106A | LC-103 | LV-103 | HC-119 | HV-107 |
| iPS:454649 | 02A | LC-06 | LV-04 | HC-03 | HV-02 | 105A | LC-103 | LV-103 | HC-117 | HV-106 |
| iPS:454651 | 02A | LC-06 | LV-04 | HC-03 | HV-02 | 111A | LC-103 | LV-103 | HC-129 | HV-112 |
| iPS:454653 | 02A | LC-06 | LV-04 | HC-03 | HV-02 | 103A | LC-103 | LV-103 | HC-113 | HV-104 |
| iPS:454655 | 02A | LC-06 | LV-04 | HC-03 | HV-02 | 107A | LC-103 | LV-103 | HC-121 | HV-108 |
| iPS:454657 | 02A | LC-06 | LV-04 | HC-03 | HV-02 | 116A | LC-103 | LV-103 | HC-139 | HV-117 |
| iPS:454659 | 02A | LC-06 | LV-04 | HC-03 | HV-02 | 104A | LC-103 | LV-103 | HC-115 | HV-105 |
| iPS:454661 | 02A | LC-06 | LV-04 | HC-03 | HV-02 | 110A | LC-103 | LV-103 | HC-127 | HV-111 |
| iPS:454663 | 02A | LC-06 | LV-04 | HC-03 | HV-02 | 108A | LC-104 | LV-104 | HC-123 | HV-109 |
| iPS:454665 | 03A | LC-08 | LV-01 | HC-09 | HV-03 | 113A | LC-106 | LV-106 | HC-133 | HV-114 |
| iPS:454667 | 03A | LC-08 | LV-01 | HC-09 | HV-03 | 122A | LC-110 | LV-110 | HC-151 | HV-123 |
| iPS:454669 | 03A | LC-08 | LV-01 | HC-09 | HV-03 | 115A | LC-107 | LV-107 | HC-137 | HV-116 |
| iPS:454671 | 03A | LC-08 | LV-01 | HC-09 | HV-03 | 118A | LC-106 | LV-106 | HC-143 | HV-119 |
| iPS:454673 | 03A | LC-08 | LV-01 | HC-09 | HV-03 | 119A | LC-106 | LV-106 | HC-145 | HV-120 |

TABLE 8-continued

Exemplary Anti-CGRP Receptor/Anti-PACI Receptor Heterodimeric Antibodies

| Heterodimeric Antibody Designation | Anti-CGRP Receptor Antibody ID. | Anti-CGRP Receptor Ab Full Light Chain | Anti-CGRP Receptor Ab VL | Anti-CGRP Receptor Ab Full Heavy Chain | Anti-CGRP Receptor Ab VH | Anti-PAC1 Receptor Antibody ID. | Anti-PAC1 Receptor Ab Full Light Chain | Anti-PAC1 Receptor Ab VL | Anti-PAC1 Receptor Ab Full Heavy Chain | Anti-PAC1 Receptor Ab VH |
|---|---|---|---|---|---|---|---|---|---|---|
| iPS:454675 | 03A | LC-08 | LV-01 | HC-09 | HV-03 | 109A | LC-103 | LV-103 | HC-125 | HV-110 |
| iPS:454677 | 03A | LC-08 | LV-01 | HC-09 | HV-03 | 114A | LC-106 | LV-106 | HC-135 | HV-115 |
| iPS:454679 | 03A | LC-08 | LV-01 | HC-09 | HV-03 | 117A | LC-106 | LV-106 | HC-141 | HV-118 |
| iPS:454681 | 03A | LC-08 | LV-01 | HC-09 | HV-03 | 120A | LC-108 | LV-108 | HC-147 | HV-121 |
| iPS:454683 | 03A | LC-08 | LV-01 | HC-09 | HV-03 | 121A | LC-109 | LV-109 | HC-149 | HV-122 |
| iPS:454685 | 03A | LC-08 | LV-01 | HC-09 | HV-03 | 102A | LC-102 | LV-102 | HC-109 | HV-103 |
| iPS:454687 | 03A | LC-08 | LV-01 | HC-09 | HV-03 | 123A | LC-102 | LV-102 | HC-149 | HV-122 |
| iPS:454689 | 03A | LC-08 | LV-01 | HC-09 | HV-03 | 124A | LC-102 | LV-102 | HC-153 | HV-124 |
| iPS:454691 | 03A | LC-08 | LV-01 | HC-09 | HV-03 | 125A | LC-102 | LV-102 | HC-155 | HV-125 |
| iPS:454693 | 03A | LC-08 | LV-01 | HC-09 | HV-03 | 101A | LC-102 | LV-102 | HC-102 | HV-102 |
| iPS:454695 | 03A | LC-08 | LV-01 | HC-09 | HV-03 | 126A | LC-102 | LV-102 | HC-157 | HV-126 |
| iPS:454697 | 03A | LC-08 | LV-01 | HC-09 | HV-03 | 127A | LC-102 | LV-102 | HC-159 | HV-127 |
| iPS:454699 | 03A | LC-08 | LV-01 | HC-09 | HV-03 | 128A | LC-111 | LV-111 | HC-161 | HV-128 |
| iPS:454701 | 03A | LC-08 | LV-01 | HC-09 | HV-03 | 129A | LC-111 | LV-111 | HC-163 | HV-129 |
| iPS:454703 | 03A | LC-08 | LV-01 | HC-09 | HV-03 | 130A | LC-111 | LV-111 | HC-165 | HV-130 |
| iPS:454705 | 03A | LC-08 | LV-01 | HC-09 | HV-03 | 131A | LC-102 | LV-102 | HC-167 | HV-131 |
| iPS:454707 | 03A | LC-08 | LV-01 | HC-09 | HV-03 | 132A | LC-102 | LV-102 | HC-169 | HV-132 |
| iPS:454709 | 03A | LC-08 | LV-01 | HC-09 | HV-03 | 112A | LC-105 | LV-105 | HC-131 | HV-113 |
| iPS:454711 | 03A | LC-08 | LV-01 | HC-09 | HV-03 | 106A | LC-103 | LV-103 | HC-119 | HV-107 |
| iPS:454713 | 03A | LC-08 | LV-01 | HC-09 | HV-03 | 105A | LC-103 | LV-103 | HC-117 | HV-106 |
| iPS:454715 | 03A | LC-08 | LV-01 | HC-09 | HV-03 | 111A | LC-103 | LV-103 | HC-129 | HV-112 |
| iPS:454717 | 03A | LC-08 | LV-01 | HC-09 | HV-03 | 103A | LC-103 | LV-103 | HC-113 | HV-104 |
| iPS:454719 | 03A | LC-08 | LV-01 | HC-09 | HV-03 | 107A | LC-103 | LV-103 | HC-121 | HV-108 |
| iPS:454721 | 03A | LC-08 | LV-01 | HC-09 | HV-03 | 116A | LC-103 | LV-103 | HC-139 | HV-117 |
| iPS:454723 | 03A | LC-08 | LV-01 | HC-09 | HV-03 | 104A | LC-103 | LV-103 | HC-115 | HV-105 |
| iPS:454725 | 03A | LC-08 | LV-01 | HC-09 | HV-03 | 110A | LC-103 | LV-103 | HC-127 | HV-111 |
| iPS:454727 | 03A | LC-08 | LV-01 | HC-09 | HV-03 | 108A | LC-104 | LV-104 | HC-123 | HV-109 |
| iPS:454729 | 01B | LC-04 | LV-03 | HC-04 | HV-02 | 113B | LC-106 | LV-106 | HC-134 | HV-114 |
| iPS:454731 | 01B | LC-04 | LV-03 | HC-04 | HV-02 | 122B | LC-110 | LV-110 | HC-152 | HV-123 |
| iPS:454733 | 01B | LC-04 | LV-03 | HC-04 | HV-02 | 115B | LC-107 | LV-107 | HC-138 | HV-116 |
| iPS:454735 | 01B | LC-04 | LV-03 | HC-04 | HV-02 | 118B | LC-106 | LV-106 | HC-144 | HV-119 |
| iPS:454737 | 01B | LC-04 | LV-03 | HC-04 | HV-02 | 119B | LC-106 | LV-106 | HC-146 | HV-120 |
| iPS:454739 | 01B | LC-04 | LV-03 | HC-04 | HV-02 | 109B | LC-103 | LV-103 | HC-126 | HV-110 |
| iPS:454741 | 01B | LC-04 | LV-03 | HC-04 | HV-02 | 114B | LC-106 | LV-106 | HC-136 | HV-115 |
| iPS:454743 | 01B | LC-04 | LV-03 | HC-04 | HV-02 | 117B | LC-106 | LV-106 | HC-142 | HV-118 |
| iPS:454745 | 01B | LC-04 | LV-03 | HC-04 | HV-02 | 120B | LC-108 | LV-108 | HC-148 | HV-121 |
| iPS:454747 | 01B | LC-04 | LV-03 | HC-04 | HV-02 | 121B | LC-109 | LV-109 | HC-150 | HV-122 |
| iPS:454749 | 01B | LC-04 | LV-03 | HC-04 | HV-02 | 102B | LC-102 | LV-102 | HC-110 | HV-103 |
| iPS:454751 | 01B | LC-04 | LV-03 | HC-04 | HV-02 | 123B | LC-102 | LV-102 | HC-150 | HV-122 |
| iPS:454753 | 01B | LC-04 | LV-03 | HC-04 | HV-02 | 124B | LC-102 | LV-102 | HC-154 | HV-124 |
| iPS:454755 | 01B | LC-04 | LV-03 | HC-04 | HV-02 | 125B | LC-102 | LV-102 | HC-156 | HV-125 |
| iPS:454757 | 01B | LC-04 | LV-03 | HC-04 | HV-02 | 101B | LC-102 | LV-102 | HC-103 | HV-102 |
| iPS:454759 | 01B | LC-04 | LV-03 | HC-04 | HV-02 | 126B | LC-102 | LV-102 | HC-158 | HV-126 |
| iPS:454761 | 01B | LC-04 | LV-03 | HC-04 | HV-02 | 127B | LC-102 | LV-102 | HC-160 | HV-127 |
| iPS:454763 | 01B | LC-04 | LV-03 | HC-04 | HV-02 | 128B | LC-111 | LV-111 | HC-162 | HV-128 |
| iPS:454765 | 01B | LC-04 | LV-03 | HC-04 | HV-02 | 129B | LC-111 | LV-111 | HC-164 | HV-129 |
| iPS:454767 | 01B | LC-04 | LV-03 | HC-04 | HV-02 | 130B | LC-111 | LV-111 | HC-166 | HV-130 |
| iPS:454769 | 01B | LC-04 | LV-03 | HC-04 | HV-02 | 131B | LC-102 | LV-102 | HC-168 | HV-131 |
| iPS:454771 | 01B | LC-04 | LV-03 | HC-04 | HV-02 | 132B | LC-102 | LV-102 | HC-170 | HV-132 |
| iPS:454773 | 01B | LC-04 | LV-03 | HC-04 | HV-02 | 112B | LC-105 | LV-105 | HC-132 | HV-113 |
| iPS:454775 | 01B | LC-04 | LV-03 | HC-04 | HV-02 | 106B | LC-103 | LV-103 | HC-120 | HV-107 |
| iPS:454777 | 01B | LC-04 | LV-03 | HC-04 | HV-02 | 105B | LC-103 | LV-103 | HC-118 | HV-106 |
| iPS:454779 | 01B | LC-04 | LV-03 | HC-04 | HV-02 | 111B | LC-103 | LV-103 | HC-130 | HV-112 |
| iPS:454781 | 01B | LC-04 | LV-03 | HC-04 | HV-02 | 103B | LC-103 | LV-103 | HC-114 | HV-104 |
| iPS:454783 | 01B | LC-04 | LV-03 | HC-04 | HV-02 | 107B | LC-103 | LV-103 | HC-122 | HV-108 |
| iPS:454785 | 01B | LC-04 | LV-03 | HC-04 | HV-02 | 116B | LC-103 | LV-103 | HC-140 | HV-117 |
| iPS:454787 | 01B | LC-04 | LV-03 | HC-04 | HV-02 | 104B | LC-103 | LV-103 | HC-116 | HV-105 |
| iPS:454789 | 01B | LC-04 | LV-03 | HC-04 | HV-02 | 110B | LC-103 | LV-103 | HC-128 | HV-111 |
| iPS:454791 | 01B | LC-04 | LV-03 | HC-04 | HV-02 | 108B | LC-104 | LV-104 | HC-124 | HV-109 |
| iPS:454793 | 02B | LC-06 | LV-04 | HC-04 | HV-02 | 113B | LC-106 | LV-106 | HC-134 | HV-114 |
| iPS:454795 | 02B | LC-06 | LV-04 | HC-04 | HV-02 | 122B | LC-110 | LV-110 | HC-152 | HV-123 |
| iPS:454797 | 02B | LC-06 | LV-04 | HC-04 | HV-02 | 115B | LC-107 | LV-107 | HC-138 | HV-116 |
| iPS:454799 | 02B | LC-06 | LV-04 | HC-04 | HV-02 | 118B | LC-106 | LV-106 | HC-144 | HV-119 |
| iPS:454801 | 02B | LC-06 | LV-04 | HC-04 | HV-02 | 119B | LC-106 | LV-106 | HC-146 | HV-120 |
| iPS:454803 | 02B | LC-06 | LV-04 | HC-04 | HV-02 | 109B | LC-103 | LV-103 | HC-126 | HV-110 |
| iPS:454805 | 02B | LC-06 | LV-04 | HC-04 | HV-02 | 114B | LC-106 | LV-106 | HC-136 | HV-115 |
| iPS:454807 | 02B | LC-06 | LV-04 | HC-04 | HV-02 | 117B | LC-106 | LV-106 | HC-142 | HV-118 |
| iPS:454809 | 02B | LC-06 | LV-04 | HC-04 | HV-02 | 120B | LC-108 | LV-108 | HC-148 | HV-121 |
| iPS:454811 | 02B | LC-06 | LV-04 | HC-04 | HV-02 | 121B | LC-109 | LV-109 | HC-150 | HV-122 |
| iPS:454813 | 02B | LC-06 | LV-04 | HC-04 | HV-02 | 102B | LC-102 | LV-102 | HC-110 | HV-103 |
| iPS:454815 | 02B | LC-06 | LV-04 | HC-04 | HV-02 | 123B | LC-102 | LV-102 | HC-150 | HV-122 |

TABLE 8-continued

Exemplary Anti-CGRP Receptor/Anti-PACI Receptor Heterodimeric Antibodies

| Heterodimeric Antibody Designation | Anti-CGRP Receptor Antibody ID. | Anti-CGRP Receptor Ab Full Light Chain | Anti-CGRP Receptor Ab VL | Anti-CGRP Receptor Ab Full Heavy Chain | Anti-CGRP Receptor Ab VH | Anti-PAC1 Receptor Antibody ID. | Anti-PAC1 Receptor Ab Full Light Chain | Anti-PAC1 Receptor Ab VL | Anti-PAC1 Receptor Ab Full Heavy Chain | Anti-PAC1 Receptor Ab VH |
|---|---|---|---|---|---|---|---|---|---|---|
| iPS:454817 | 02B | LC-06 | LV-04 | HC-04 | HV-02 | 124B | LC-102 | LV-102 | HC-154 | HV-124 |
| iPS:454819 | 02B | LC-06 | LV-04 | HC-04 | HV-02 | 125B | LC-102 | LV-102 | HC-156 | HV-125 |
| iPS:454821 | 02B | LC-06 | LV-04 | HC-04 | HV-02 | 101B | LC-102 | LV-102 | HC-103 | HV-102 |
| iPS:454823 | 02B | LC-06 | LV-04 | HC-04 | HV-02 | 126B | LC-102 | LV-102 | HC-158 | HV-126 |
| iPS:454825 | 02B | LC-06 | LV-04 | HC-04 | HV-02 | 127B | LC-102 | LV-102 | HC-160 | HV-127 |
| iPS:454827 | 02B | LC-06 | LV-04 | HC-04 | HV-02 | 128B | LC-111 | LV-111 | HC-162 | HV-128 |
| iPS:454829 | 02B | LC-06 | LV-04 | HC-04 | HV-02 | 129B | LC-111 | LV-111 | HC-164 | HV-129 |
| iPS:454831 | 02B | LC-06 | LV-04 | HC-04 | HV-02 | 130B | LC-111 | LV-111 | HC-166 | HV-130 |
| iPS:454833 | 02B | LC-06 | LV-04 | HC-04 | HV-02 | 131B | LC-102 | LV-102 | HC-168 | HV-131 |
| iPS:454835 | 02B | LC-06 | LV-04 | HC-04 | HV-02 | 132B | LC-102 | LV-102 | HC-170 | HV-132 |
| iPS:454837 | 02B | LC-06 | LV-04 | HC-04 | HV-02 | 112B | LC-105 | LV-105 | HC-132 | HV-113 |
| iPS:454839 | 02B | LC-06 | LV-04 | HC-04 | HV-02 | 106B | LC-103 | LV-103 | HC-120 | HV-107 |
| iPS:454841 | 02B | LC-06 | LV-04 | HC-04 | HV-02 | 105B | LC-103 | LV-103 | HC-118 | HV-106 |
| iPS:454843 | 02B | LC-06 | LV-04 | HC-04 | HV-02 | 111B | LC-103 | LV-103 | HC-130 | HV-112 |
| iPS:454845 | 02B | LC-06 | LV-04 | HC-04 | HV-02 | 103B | LC-103 | LV-103 | HC-114 | HV-104 |
| iPS:454847 | 02B | LC-06 | LV-04 | HC-04 | HV-02 | 107B | LC-103 | LV-103 | HC-122 | HV-108 |
| iPS:454849 | 02B | LC-06 | LV-04 | HC-04 | HV-02 | 116B | LC-103 | LV-103 | HC-140 | HV-117 |
| iPS:454851 | 02B | LC-06 | LV-04 | HC-04 | HV-02 | 104B | LC-103 | LV-103 | HC-116 | HV-105 |
| iPS:454853 | 02B | LC-06 | LV-04 | HC-04 | HV-02 | 110B | LC-103 | LV-103 | HC-128 | HV-111 |
| iPS:454855 | 02B | LC-06 | LV-04 | HC-04 | HV-02 | 108B | LC-104 | LV-104 | HC-124 | HV-109 |
| iPS:454857 | 03B | LC-08 | LV-01 | HC-10 | HV-03 | 113B | LC-106 | LV-106 | HC-134 | HV-114 |
| iPS:454859 | 03B | LC-08 | LV-01 | HC-10 | HV-03 | 122B | LC-110 | LV-110 | HC-152 | HV-123 |
| iPS:454861 | 03B | LC-08 | LV-01 | HC-10 | HV-03 | 115B | LC-107 | LV-107 | HC-138 | HV-116 |
| iPS:454863 | 03B | LC-08 | LV-01 | HC-10 | HV-03 | 118B | LC-106 | LV-106 | HC-144 | HV-119 |
| iPS:454865 | 03B | LC-08 | LV-01 | HC-10 | HV-03 | 119B | LC-106 | LV-106 | HC-146 | HV-120 |
| iPS:454867 | 03B | LC-08 | LV-01 | HC-10 | HV-03 | 109B | LC-103 | LV-103 | HC-126 | HV-110 |
| iPS:454869 | 03B | LC-08 | LV-01 | HC-10 | HV-03 | 114B | LC-106 | LV-106 | HC-136 | HV-115 |
| iPS:454871 | 03B | LC-08 | LV-01 | HC-10 | HV-03 | 117B | LC-106 | LV-106 | HC-142 | HV-118 |
| iPS:454873 | 03B | LC-08 | LV-01 | HC-10 | HV-03 | 120B | LC-108 | LV-108 | HC-148 | HV-121 |
| iPS:454875 | 03B | LC-08 | LV-01 | HC-10 | HV-03 | 121B | LC-109 | LV-109 | HC-150 | HV-122 |
| iPS:454877 | 03B | LC-08 | LV-01 | HC-10 | HV-03 | 102B | LC-102 | LV-102 | HC-110 | HV-103 |
| iPS:454879 | 03B | LC-08 | LV-01 | HC-10 | HV-03 | 123B | LC-102 | LV-102 | HC-150 | HV-122 |
| iPS:454881 | 03B | LC-08 | LV-01 | HC-10 | HV-03 | 124B | LC-102 | LV-102 | HC-154 | HV-124 |
| iPS:454883 | 03B | LC-08 | LV-01 | HC-10 | HV-03 | 125B | LC-102 | LV-102 | HC-156 | HV-125 |
| iPS:454885 | 03B | LC-08 | LV-01 | HC-10 | HV-03 | 101B | LC-102 | LV-102 | HC-103 | HV-102 |
| iPS:454887 | 03B | LC-08 | LV-01 | HC-10 | HV-03 | 126B | LC-102 | LV-102 | HC-158 | HV-126 |
| iPS:454889 | 03B | LC-08 | LV-01 | HC-10 | HV-03 | 127B | LC-102 | LV-102 | HC-160 | HV-127 |
| iPS:454891 | 03B | LC-08 | LV-01 | HC-10 | HV-03 | 128B | LC-111 | LV-111 | HC-162 | HV-128 |
| iPS:454893 | 03B | LC-08 | LV-01 | HC-10 | HV-03 | 129B | LC-111 | LV-111 | HC-164 | HV-129 |
| iPS:454895 | 03B | LC-08 | LV-01 | HC-10 | HV-03 | 130B | LC-111 | LV-111 | HC-166 | HV-130 |
| iPS:454897 | 03B | LC-08 | LV-01 | HC-10 | HV-03 | 131B | LC-102 | LV-102 | HC-168 | HV-131 |
| iPS:454899 | 03B | LC-08 | LV-01 | HC-10 | HV-03 | 132B | LC-102 | LV-102 | HC-170 | HV-132 |
| iPS:454901 | 03B | LC-08 | LV-01 | HC-10 | HV-03 | 112B | LC-105 | LV-105 | HC-132 | HV-113 |
| iPS:454903 | 03B | LC-08 | LV-01 | HC-10 | HV-03 | 106B | LC-103 | LV-103 | HC-120 | HV-107 |
| iPS:454905 | 03B | LC-08 | LV-01 | HC-10 | HV-03 | 105B | LC-103 | LV-103 | HC-118 | HV-106 |
| iPS:454907 | 03B | LC-08 | LV-01 | HC-10 | HV-03 | 111B | LC-103 | LV-103 | HC-130 | HV-112 |
| iPS:454909 | 03B | LC-08 | LV-01 | HC-10 | HV-03 | 103B | LC-103 | LV-103 | HC-114 | HV-104 |
| iPS:454911 | 03B | LC-08 | LV-01 | HC-10 | HV-03 | 107B | LC-103 | LV-103 | HC-122 | HV-108 |
| iPS:454913 | 03B | LC-08 | LV-01 | HC-10 | HV-03 | 116B | LC-103 | LV-103 | HC-140 | HV-117 |
| iPS:454915 | 03B | LC-08 | LV-01 | HC-10 | HV-03 | 104B | LC-103 | LV-103 | HC-116 | HV-105 |
| iPS:454917 | 03B | LC-08 | LV-01 | HC-10 | HV-03 | 110B | LC-103 | LV-103 | HC-128 | HV-111 |
| iPS:454919 | 03B | LC-08 | LV-01 | HC-10 | HV-03 | 108B | LC-104 | LV-104 | HC-124 | HV-109 |
| iPS:571009 (5602) | 01C | LC-04 | LV-03 | HC-03 | HV-02 | 102C | LC-102 | LV-102 | HC-111 | HV-103 |
| iPS:571015 (5603) | 01D | LC-04 | LV-03 | HC-05 | HV-02 | 102D | LC-102 | LV-102 | HC-112 | HV-103 |
| iPS:571017 (5604) | 01E | LC-04 | LV-03 | HC-06 | HV-02 | 101E | LC-102 | LV-102 | HC-106 | HV-102 |
| iPS:571025 (5605) | 01F | LC-04 | LV-03 | HC-06 | HV-02 | 101F | LC-102 | LV-102 | HC-107 | HV-102 |
| iPS:571023 (5607) | 01C | LC-04 | LV-03 | HC-03 | HV-02 | 101C | LC-102 | LV-102 | HC-104 | HV-102 |
| iPS:571033 (5608) | 01D | LC-04 | LV-03 | HC-05 | HV-02 | 101D | LC-102 | LV-102 | HC-105 | HV-102 |
| iPS:571824 (5609) | 01G | LC-04 | LV-03 | HC-07 | HV-02 | 101G | LC-102 | LV-102 | HC-108 | HV-102 |

In certain embodiments, the bispecific antigen binding protein of the invention is a heterodimeric antibody selected from the antibodies designated as iPS:454537, iPS:454539, iPS:454541, iPS:454543, iPS:454545, iPS:454547, iPS:454549, iPS:454551, iPS:454553, iPS:454555, iPS:454557 (5601), iPS:454559, iPS:454561, iPS:454563, iPS:454565 (5606), iPS:454567, iPS:454569, iPS:454571, iPS:454573, iPS:454575, iPS:454577, iPS:454579, iPS:454581, iPS:454583, iPS:454585, iPS:454587, iPS:454589, iPS:454591, iPS:454593, iPS:454595, iPS:454597, iPS:454599, iPS:454601, iPS:454603, iPS:454605, iPS:454607, iPS:454609, iPS:454611, iPS:454613, iPS:454615, iPS:454617, iPS:454619, iPS:454621, iPS:454623, iPS:454625, iPS:454627, iPS:454629, iPS:454631, iPS:454633, iPS:454635, iPS:454637, iPS:454639, iPS:454641, iPS:454643, iPS:454645, iPS:454647, iPS:454649, iPS:454651, iPS:454653, iPS:454655, iPS:454657, iPS:454659, iPS:454661, iPS:454663, iPS:454665, iPS:454667, iPS:454669, iPS:454671, iPS:454673, iPS:454675, iPS:454677, iPS:454679, iPS:454681, iPS:454683, iPS:454685, iPS:454687, iPS:454689, iPS:454691, iPS:454693, iPS:454695, iPS:454697, iPS:454699, iPS:454701, iPS:454703, iPS:454705, iPS:454707, iPS:454709, iPS:454711, iPS:454713, iPS:454715, iPS:454717, iPS:454719, iPS:454721, iPS:454723, iPS:454725, iPS:454727, iPS:454729, iPS:454731, iPS:454733, iPS:454735, iPS:454737, iPS:454739, iPS:454741, iPS:454743, iPS:454745, iPS:454747, iPS:454749, iPS:454751, iPS:454753, iPS:454755, iPS:454757, iPS:454759, iPS:454761, iPS:454763, iPS:454765, iPS:454767, iPS:454769, iPS:454771, iPS:454773, iPS:454775, iPS:454777, iPS:454779, iPS:454781, iPS:454783, iPS:454785, iPS:454787, iPS:454789, iPS:454791, iPS:454793, iPS:454795, iPS:454797, iPS:454799, iPS:454801, iPS:454803, iPS:454805, iPS:454807, iPS:454809, iPS:454811, iPS:454813, iPS:454815, iPS:454817, iPS:454819, iPS:454821, iPS:454823, iPS:454825, iPS:454827, iPS:454829, iPS:454831, iPS:454833, iPS:454835, iPS:454837, iPS:454839, iPS:454841, iPS:454843, iPS:454845, iPS:454847, iPS:454849, iPS:454851, iPS:454853, iPS:454855, iPS:454857, iPS:454859, iPS:454861, iPS:454863, iPS:454865, iPS:454867, iPS:454869, iPS:454871, iPS:454873, iPS:454875, iPS:454877, iPS:454879, iPS:454881, iPS:454883, iPS:454885, iPS:454887, iPS:454889, iPS:454891, iPS:454893, iPS:454895, iPS:454897, iPS:454899, iPS:454901, iPS:454903, iPS:454905, iPS:454907, iPS:454909, iPS:454911, iPS:454913, iPS:454915, iPS:454917, iPS:454919, iPS:571009 (5602), iPS:571015 (5603), iPS:571017 (5604), iPS:571025 (5605), iPS:571023 (5607), iPS:571033 (5608), and iPS:571824 (5609) as set forth in Table 8. In some embodiments, the heterodimeric antibody is an antibody selected from the antibodies designated as iPS:454557 (5601), iPS:454565 (5606), iPS:454583, iPS:454585, iPS:454587, iPS:454729, iPS:454731, iPS:454733, iPS:454735, iPS:454737, iPS:454739, iPS:454741, iPS:454743, iPS:454745, iPS:454747, iPS:454749, iPS:454751, iPS:454753, iPS:454755, iPS:454757, iPS:454759, iPS:454761, iPS:454763, iPS:454765, iPS:454767, iPS:454769, iPS:454771, iPS:454773, iPS:454775, iPS:454783, iPS:454785, iPS:454787, iPS:454789, iPS:454791, iPS:454793, iPS:454795, iPS:454797, iPS:454799, iPS:454801, iPS:454803, iPS:454805, iPS:454807, iPS:454809, iPS:454811, iPS:454813, iPS:454815, iPS:454817, iPS:454819, iPS:454821, iPS:454823, iPS:454825, iPS:454827, iPS:454829, iPS:454831, iPS:454833, iPS:454835, iPS:454837, iPS:454839, iPS:454841, iPS:454843, iPS:454845, iPS:454847, iPS:454849, iPS:454851, iPS:454853, iPS:454855, iPS:454857, iPS:454859, iPS:454861, iPS:454863, iPS:454865, iPS:454867, iPS:454869, iPS:454871, iPS:454873, iPS:454875, iPS:454877, iPS:454879, iPS:454881, iPS:454883, iPS:454885, iPS:454887, iPS:454889, iPS:454891, iPS:454893, iPS:454895, iPS:454897, iPS:454899, iPS:454901, iPS:454903, iPS:454905, iPS:454907, iPS:454909, iPS:454911, iPS:454913, iPS:454915, iPS:454917, iPS:454919, iPS:571009 (5602), iPS:571015 (5603), iPS:571017 (5604), iPS:571025 (5605), iPS:571023 (5607), iPS:571033 (5608), and iPS:571824 (5609) as set forth in Table 8. In certain embodiments, the heterodimeric antibody is an antibody selected from the antibodies designated as iPS:454557 (5601), iPS:454565 (5606), iPS:571009 (5602), iPS:571015 (5603), iPS:571017 (5604), iPS:571025 (5605), iPS:571023 (5607), iPS:571033 (5608), iPS:571824 (5609), iPS:454745, iPS:454749, iPS:454751, iPS:454753, iPS:454755, iPS:454757, iPS:454759, iPS:454761, iPS:454763, iPS:454765, iPS:454767, iPS:454769, iPS:454771, iPS:454775, iPS:454787, iPS:454789, iPS:454791, iPS:454793, iPS:454797, iPS:454799, iPS:454815, iPS:454817, iPS:454819, iPS:454821, iPS:454823, iPS:454825, iPS:454827, iPS:454829, iPS:454831, iPS:454833, iPS:454835, iPS:454839, iPS:454841, iPS:454843, iPS:454845, and iPS:454851 as set forth in Table 8. In certain other embodiments, the heterodimeric antibody is an antibody selected from the antibodies designated iPS:454557 (5601), iPS:571009 (5602), iPS:571015 (5603), iPS:571017 (5604), iPS:571025 (5605), iPS:454565 (5606), iPS:571023 (5607), iPS:571033 (5608), and iPS:571824 (5609) as set forth in Table 8. In one embodiment, the heterodimeric antibody is the antibody designated as iPS:571025 (5605) as set forth in Table 8. In another embodiment, the heterodimeric antibody is the antibody designated as iPS:454565 (5606) as set forth in Table 8. In yet another embodiment, the heterodimeric antibody is the antibody designated as iPS:571023 (5607) as set forth in Table 8.

The inventive heterodimeric antibodies also encompass antibodies comprising the heavy chain(s) and/or light chain (s) described herein, where one, two, three, four or five amino acid residues are lacking from the N-terminus or C-terminus, or both, in relation to any one of the heavy and light chains set forth in Tables 5A, 5B, 7A, and 7B, e.g., due to post-translational modifications resulting from the type of host cell in which the antibodies are expressed. For instance, Chinese Hamster Ovary (CHO) cells frequently cleave off a C-terminal lysine from antibody heavy chains.

The bispecific antigen binding proteins of the invention, such as the heterodimeric antibodies described herein, preferably inhibit activation of human CGRP receptor and human PAC1 receptor by their respective ligands. Methods of assessing ligand-induced activation of the CGRP receptor or ligand binding to the CGRP receptor are described above. Similar assays can be used to assess ligand-induced activation of the PAC1 receptor or ligand binding to the PAC1 receptor. For instance, cell-based assays measuring ligand-induced calcium mobilization and cAMP production can be used to assess activation of PAC1 receptors. The ligand can be an endogenous ligand of the receptor, such as PACAP38 or PACAP27, or the ligand can be another known agonist of the receptor, such as maxadilan. Maxadilan is a 65 amino acid peptide originally isolated from the sand fly that is exquisitely selective for PAC1 compared with VPAC1 or VPAC2, and can thus be used as a PAC1-selective agonist (Lerner et al., J Biol Chem., Vol. 266(17):11234-11236, 1991; Lerner et al., Peptides, Vol. 28(9): 1651-1654, 2007). An exemplary cell-based cAMP assay for assessing PAC1 receptor activation is described in Example 2. Other suitable PAC1 receptor activation assays are described in Dickson et al., Ann. N.Y. Acad. Sci., Vol. 1070:239-42, 2006; Bourgault et al., J. Med. Chem., Vol. 52: 3308-3316, 2009; and U.S. Patent Publication No. 2011/0229423, all of which are hereby incorporated by reference in their entireties.

In some embodiments, the bispecific antigen binding proteins (e.g. heterodimeric antibodies) of the invention inhibit PACAP (e.g. PACAP38 or PACAP27)-induced activation of human PAC1 receptor. For example, the bispecific antigen binding proteins (e.g. heterodimeric antibodies) may inhibit PACAP-induced activation of the human PAC1 receptor with an IC50 less than about 10 nM, less than about 8 nM, less than about 5 nM, less than about 3 nM, less than about 1 nM, less than about 800 pM, less than about 700 pM, or less than about 600 pM as measured by a cell-based cAMP or calcium mobilization assay. In one particular embodiment, the bispecific antigen binding proteins (e.g. heterodimeric antibodies) of the invention inhibit PACAP-induced activation of the human PAC1 receptor with an IC50 less than about 5 nM as measured by a cell-based cAMP assay. In another particular embodiment, the bispecific antigen binding proteins (e.g. heterodimeric antibodies) of the invention inhibit PACAP-induced activation of the human PAC1 receptor with an IC50 less than about 1 nM as measured by a cell-based cAMP assay. In still another particular embodiment, the bispecific antigen binding proteins (e.g. heterodimeric antibodies) of the invention inhibit PACAP-induced activation of the human PAC1 receptor with an IC50 less than about 800 pM as measured by a cell-based cAMP assay. In some embodiments, the bispecific antigen binding proteins (e.g. heterodimeric antibodies) of the invention inhibit PACAP-induced activation of the human PAC1 receptor with an IC50 between about 0.5 nM and about 5 nM as measured by a cell-based cAMP assay. In other embodiments, the bispecific antigen binding proteins (e.g. heterodimeric antibodies) of the invention inhibit PACAP-induced activation of the human PAC1 receptor with an IC50 between about 0.6 nM and about 3 nM as measured by a cell-based cAMP assay. In still other embodiments, the bispecific antigen binding proteins (e.g. heterodimeric antibodies) of the invention inhibit PACAP-induced activation of the human PAC1 receptor with an IC50 between about 0.5 nM and about 1 nM as measured by a cell-based cAMP assay. In certain embodiments, the bispecific antigen binding proteins (e.g. heterodimeric antibodies) of the invention inhibit CGRP-induced activation of human CGRP receptor with an IC50 less than about 1 nM and inhibit PACAP-induced activation of the human PAC1 receptor with an IC50 less than about 5 nM, both IC50 values determined by a cell-based cAMP assay. In certain other embodiments, the bispecific antigen binding proteins (e.g. heterodimeric antibodies) of the invention inhibit CGRP-induced activation of human CGRP receptor with an IC50 less than about 500 pM and inhibit PACAP-induced activation of the human PAC1 receptor with an IC50 less than about 1 nM, both IC50 values determined by a cell-based cAMP assay.

In certain embodiments, the anti-CGRP receptor antibodies and the bispecific antigen binding proteins of the invention may comprise one or more mutations or modifications to a constant region. For example, the heavy chain constant regions or the Fc regions of the anti-CGRP receptor antibodies or the bispecific antigen binding proteins may comprise one or more amino acid substitutions that affect the glycosylation, effector function, and/or Fcγ receptor binding of the antibody or antigen binding protein. One of the functions of the Fc region of an immunoglobulin is to communicate to the immune system when the immunoglobulin binds its target. This is commonly referred to as "effector function." Communication leads to antibody-dependent cellular cytotoxicity (ADCC), antibody-dependent cellular phagocytosis (ADCP), and/or complement dependent cytotoxicity (CDC). ADCC and ADCP are mediated through the binding of the Fc region to Fc receptors on the surface of cells of the immune system. CDC is mediated through the binding of the Fc with proteins of the complement system, e.g., C1q.

In some embodiments, the anti-CGRP receptor antibodies and bispecific antigen binding proteins of the invention comprise one or more amino acid substitutions in the constant region to enhance effector function, including ADCC activity, CDC activity, ADCP activity, and/or the clearance or half-life of the antibody or antigen binding protein. Exemplary amino acid substitutions (amino acid positions according to EU numbering scheme) that can enhance effector function include, but are not limited to, E233L, L234I, L234Y, L235S, G236A, S239D, F243L, F243V, P2471, D280H, K290S, K290E, K290N, K290Y, R292P, E294L, Y296W, S298A, S298D, S298V, S298G, S298T, T299A, Y300L, V3051, Q311M, K326A, K326E, K326W, A330S, A330L, A330M, A330F, I332E, D333A, E333S, E333A, K334A, K334V, A339D, A339Q, P396L, or combinations of any of the foregoing.

In other embodiments, the anti-CGRP receptor antibodies and bispecific antigen binding proteins of the invention comprise one or more amino acid substitutions in the constant region to reduce effector function. Exemplary amino acid substitutions (amino acid positions according to EU numbering scheme) that can reduce effector function include, but are not limited to, C220S, C226S, C229S, E233P, L234A, L234V, V234A, L234F, L235A, L235E, G237A, P238S, S267E, H268Q, N297A, N297G, N297Q, V309L, E318A, L328F, A330S, A331S, P331S or combinations of any of the foregoing.

The anti-CGRP receptor antibodies and bispecific antigen binding proteins of the invention may comprise one or more amino acid substitutions in their constant regions that modulate the pharmacokinetic properties of the antibodies and antigen binding proteins. For example, in some embodiments, the anti-CGRP receptor antibodies and the bispecific antigen binding proteins of the invention comprise one or more amino acid substitutions in the constant region of one or both heavy chains that increase the affinity of the antibodies and antigen binding proteins for the neonatal Fc receptor (FcRn receptor), thereby increasing the circulation half-life of the antibodies and antigen binding proteins. Such amino acid substitutions (amino acid positions according to EU numbering scheme) include, but are not limited to, L251R, M252Y, M252F, M252S, M252W, M252T, S254T, R255L, R255G, R2551, T256S, T256R, T256Q, T256E, T256D, T256A, T256N, V308T, L309P, Q311S, G385R, G385D, G385S, G385T, G385H, G385K, G385A, Q386T, Q386P, Q386D, Q386S, Q386K, Q386R, Q3861, Q386M, P387R, P387H, P387S, P387T, P387A, N389P, N389S, M428T, M428L, M428F, M428S, H433K, H433R, H433S, H433I, H433P, H433Q, N434F, N434Y, N434H, Y436H, Y436N, Y436R, Y436T, Y436K, and Y436M. In certain embodiments, the anti-CGRP receptor antibodies of the invention comprise M252Y, S254T, and T256E mutations (amino acid positions according to EU numbering scheme) in one or both heavy chains. In certain other embodiments, the bispecific antigen binding proteins of the invention, such as the heterodimeric antibodies described herein, comprise M252Y, S254T, and T256E mutations (amino acid positions according to EU numbering scheme) in one or both heavy chains.

Other modifications of the anti-CGRP receptor antibodies or bispecific antigen binding proteins of the invention to increase serum half-life also may desirable, for example, by incorporation of or addition of a salvage receptor binding epitope (e.g., by mutation of the appropriate region or by incorporating the epitope into a peptide tag that is then fused to the antibody or antigen binding protein at either end or in the middle, e.g., by DNA or peptide synthesis; see, e.g., WO96/32478) or adding molecules such as PEG or other water soluble polymers, including polysaccharide polymers. The salvage receptor binding epitope preferably constitutes a region wherein any one or more amino acid residues from one or two loops of a Fc region are transferred to an analogous position in the antibody or antigen binding protein. Even more preferably, three or more residues from one or two loops of the Fc region are transferred. Still more preferred, the epitope is taken from the CH2 domain of the Fc region (e.g., an IgG Fc region) and transferred to the CH1, CH3, or VH region, or more than one such region, of the antibody or antigen binding protein. Alternatively, the epitope is taken from the CH2 domain of the Fc region and transferred to the CL region or VL region, or both, of the antigen binding protein. See International applications WO 97/34631 and WO 96/32478 for a description of Fc variants and their interaction with the salvage receptor. Other Fc modifications to increase affinity of molecules for the FcRn receptor and thereby enhance their serum half-life are described in WO 2013/096221 and may be incorporated into the Fc regions of the anti-CGRP receptor antibodies or bispecific antigen binding proteins of the invention.

Glycosylation can contribute to the effector function of antibodies, particularly IgG1 antibodies. Thus, in some embodiments, the anti-CGRP receptor antibodies and the bispecific antigen binding proteins (e.g. heterodimeric antibodies) of the invention may comprise one or more amino acid substitutions that affect the level or type of glycosylation of the antibodies or antigen binding proteins. Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

In certain embodiments, glycosylation of the anti-CGRP receptor antibodies and bispecific antigen binding proteins described herein may be increased by adding one or more glycosylation sites, e.g., to the Fc region of the antibody or antigen binding protein. Addition of glycosylation sites to the antibody or antigen binding protein can be conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the amino acid sequence for the antibody or antigen binding protein may be altered through changes at the DNA level, particularly by mutating the DNA encoding the target polypeptide at preselected bases such that codons are generated that will translate into the desired amino acids.

The invention also encompasses production of antibodies and antigen binding proteins with altered carbohydrate structure resulting in altered effector activity, including antibodies and antigen binding proteins with absent or reduced fucosylation that exhibit improved ADCC activity. Various methods are known in the art to reduce or eliminate fucosylation. For example, ADCC effector activity is mediated by binding of the antibody molecule to the FcγRIII receptor, which has been shown to be dependent on the carbohydrate structure of the N-linked glycosylation at the N297 residue of the CH2 domain. Non-fucosylated antibodies bind this receptor with increased affinity and trigger FcγRIII-mediated effector functions more efficiently than native, fucosylated antibodies. For example, recombinant production of non-fucosylated antibody in CHO cells in which the alpha-1,6-fucosyl transferase enzyme has been knocked out results in antibody with 100-fold increased ADCC activity (see Yamane-Ohnuki et al., Biotechnol Bioeng. 87(5):614-22, 2004). Similar effects can be accomplished through decreasing the activity of alpha-1,6-fucosyl transferase enzyme or other enzymes in the fucosylation pathway, e.g., through siRNA or antisense RNA treatment, engineering cell lines to knockout the enzyme(s), or culturing with selective glycosylation inhibitors (see Rothman et al., Mol Immunol. 26(12):1113-23, 1989). Some host cell strains, e.g. Lec13 or rat hybridoma YB2/0 cell line naturally produce antibodies with lower fucosylation levels (see Shields et al., J Biol Chem. 277(30):26733-40, 2002 and Shinkawa et al., J Biol Chem. 278(5):3466-73, 2003). An increase in the level of bisected carbohydrate, e.g. through recombinantly producing antibody in cells that overexpress GnTIII enzyme, has also been determined to increase ADCC activity (see Umana et al., Nat Biotechnol. 17(2):176-80, 1999).

In other embodiments, glycosylation of the anti-CGRP receptor antibodies and bispecific antigen binding proteins described herein is decreased or eliminated by removing one or more glycosylation sites, e.g., from the Fc region of the antibody or antigen binding protein. Amino acid substitutions that eliminate or alter N-linked glycosylation sites can reduce or eliminate N-linked glycosylation of the antigen binding protein. In certain embodiments, the anti-CGRP receptor antibodies or bispecific antigen binding proteins (e.g. heterodimeric antibodies) described herein comprise a mutation at amino acid position N297 (according to EU numbering scheme), such as N297Q, N297A, or N297G, in one or both heavy chains. In some embodiments, the anti-CGRP receptor antibodies or bispecific antigen binding proteins (e.g. heterodimeric antibodies) of the invention comprise an Fc region from a human IgG1 antibody with a mutation at amino acid position N297 according to EU numbering in one or both heavy chains. In one embodiment, the anti-CGRP receptor antibodies or bispecific antigen binding proteins (e.g. heterodimeric antibodies) of the invention comprise an Fc region from a human IgG1 antibody with a N297G mutation in one or both heavy chains. For instance, in some embodiments, the anti-CGRP receptor antibodies or bispecific antigen binding proteins (e.g. heterodimeric antibodies) of the invention comprise a heavy chain that comprises a heavy chain constant region comprising the sequence of SEQ ID NO: 65.

To improve the stability of molecules comprising a N297 mutation, the Fc region of the anti-CGRP receptor antibodies or bispecific antigen binding proteins (e.g. heterodimeric antibodies) may be further engineered. For instance, in some embodiments, one or more amino acids in the Fc region are substituted with cysteine to promote disulfide bond formation in the dimeric state. Residues corresponding to V259, A287, R292, V302, L306, V323, or I332 (according to the EU numbering scheme) of an IgG1 Fc region may thus be substituted with cysteine. Preferably, specific pairs of residues are substituted with cysteine such that they preferentially form a disulfide bond with each other, thus limiting or preventing disulfide bond scrambling. Preferred pairs include, but are not limited to, A287C and L306C, V259C and L306C, R292C and V302C, and V323C and I332C. In certain embodiments, the anti-CGRP receptor antibodies or bispecific antigen binding proteins (e.g. heterodimeric antibodies) described herein comprise an Fc region from a human IgG1 antibody with mutations R292C and V302C in one or both heavy chains. In such embodiments, the Fc region may also comprise a N297 mutation, such as a N297G mutation, in one or both heavy chains. In some embodiments, the anti-CGRP receptor antibodies or bispecific antigen binding proteins (e.g. heterodimeric antibodies) of the invention comprise a heavy chain that comprises a heavy chain constant region comprising the sequence of SEQ ID NO: 66.

The present invention includes one or more isolated polynucleotides or isolated nucleic acids encoding the anti-CGRP receptor antibodies or bispecific antigen binding proteins and components thereof described herein. In addition, the present invention encompasses vectors comprising the nucleic acids, host cells or cell lines comprising the nucleic acids, and methods of making the anti-CGRP receptor antibodies and bispecific antigen binding proteins of the invention. The nucleic acids comprise, for example, polynucleotides that encode all or part of an antibody, antigen-binding fragment, or bispecific antigen binding protein, for example, one or both chains of an anti-CGRP receptor antibody or heterodimeric antibody of the invention, or a fragment, derivative, or variant thereof, polynucleotides sufficient for use as hybridization probes, PCR primers or sequencing primers for identifying, analyzing, mutating or amplifying a polynucleotide encoding a polypeptide, antisense oligonucleotides for inhibiting expression of a polynucleotide, and complementary sequences of the foregoing. The nucleic acids can be any length as appropriate for the desired use or function, and can comprise one or more additional sequences, for example, regulatory sequences, and/or be part of a larger nucleic acid, for example, a vector. Nucleic acid molecules of the invention include DNA and RNA in both single-stranded and double-stranded form, as well as the corresponding complementary sequences. DNA includes, for example, cDNA, genomic DNA, chemically synthesized DNA, DNA amplified by PCR, and combinations thereof. The nucleic acid molecules of the invention include full-length genes or cDNA molecules as well as a combination of fragments thereof. The nucleic acids of the invention can be derived from human sources as well as non-human species.

Relevant amino acid sequences from an immunoglobulin or region thereof (e.g. variable region, Fc region, etc.) or polypeptide of interest may be determined by direct protein sequencing, and suitable encoding nucleotide sequences can be designed according to a universal codon table. Alternatively, genomic or cDNA encoding monoclonal antibodies or binding fragments thereof of the invention or monoclonal antibodies from which the binding domains of the bispecific antigen binding proteins of the invention may be derived can be isolated and sequenced from cells producing such antibodies using conventional procedures (e.g., by using oligonucleotide probes that are capable of binding specifically to genes encoding the heavy and light chains of the monoclonal antibodies).

An "isolated nucleic acid," which is used interchangeably herein with "isolated polynucleotide," is a nucleic acid that has been separated from adjacent genetic sequences present in the genome of the organism from which the nucleic acid was isolated, in the case of nucleic acids isolated from naturally-occurring sources. In the case of nucleic acids synthesized enzymatically from a template or chemically, such as PCR products, cDNA molecules, or oligonucleotides for example, it is understood that the nucleic acids resulting from such processes are isolated nucleic acids. An isolated nucleic acid molecule refers to a nucleic acid molecule in the form of a separate fragment or as a component of a larger nucleic acid construct. In one preferred embodiment, the nucleic acids are substantially free from contaminating endogenous material. The nucleic acid molecule has preferably been derived from DNA or RNA isolated at least once in substantially pure form and in a quantity or concentration enabling identification, manipulation, and recovery of its component nucleotide sequences by standard biochemical methods (such as those outlined in Sambrook et al., Molecular Cloning: A Laboratory Manual, 2nd ed., Cold Spring Harbor Laboratory, Cold Spring Harbor, NY (1989)). Such sequences are preferably provided and/or constructed in the form of an open reading frame uninterrupted by internal non-translated sequences, or introns, that are typically present in eukaryotic genes. Sequences of non-translated DNA can be present 5' or 3' from an open reading frame, where the same do not interfere with manipulation or expression of the coding region. Unless specified otherwise, the left-hand end of any single-stranded polynucleotide sequence discussed herein is the 5' end; the left-hand direction of double-stranded polynucleotide sequences is referred to as the 5' direction. The direction of 5' to 3' production of nascent RNA transcripts is referred to as the transcription direction; sequence regions on the DNA strand having the same sequence as the RNA transcript that are 5' to the 5' end of the RNA transcript are referred to as "upstream sequences;" sequence regions on the DNA strand having the same sequence as the RNA transcript that are 3' to the 3' end of the RNA transcript are referred to as "downstream sequences."

The present invention also includes nucleic acids that hybridize under moderately stringent conditions, and more preferably highly stringent conditions, to nucleic acids encoding polypeptides as described herein. The basic parameters affecting the choice of hybridization conditions and guidance for devising suitable conditions are set forth by Sambrook, Fritsch, and Maniatis (1989, Molecular Cloning: A Laboratory Manual, Cold Spring Harbor Laboratory Press, Cold Spring Harbor, N.Y., chapters 9 and 11; and Current Protocols in Molecular Biology, 1995, Ausubel et al., eds., John Wiley & Sons, Inc., sections 2.10 and 6.3-6.4), and can be readily determined by those having ordinary skill in the art based on, for example, the length and/or base composition of the DNA. One way of achieving moderately stringent conditions involves the use of a prewashing solution containing 5×SSC, 0.5% SDS, 1.0 mM EDTA (pH 8.0), hybridization buffer of about 50% formamide, 6×SSC, and a hybridization temperature of about 55° C. (or other similar hybridization solutions, such as one containing about 50% formamide, with a hybridization temperature of about 42° C.), and washing conditions of about 60° C., in 0.5×SSC, 0.1% SDS. Generally, highly stringent conditions are defined as hybridization conditions as above, but with washing at approximately 68° C., 0.2×SSC, 0.1% SDS. SSPE (1×SSPE is 0.15M NaCl, 10 mM $NaH_2PO_4$, and 1.25 mM EDTA, pH 7.4) can be substituted for SSC (1×SSC is 0.15M NaCl and 15 mM sodium citrate) in the hybridization and wash buffers; washes are performed for 15 minutes after hybridization is complete. It should be understood that the wash temperature and wash salt concentration can be adjusted as necessary to achieve a desired degree of stringency by applying the basic principles that govern hybridization reactions and duplex stability, as known to those skilled in the art and described further below (see, e.g., Sambrook et al., 1989).

When hybridizing a nucleic acid to a target nucleic acid of unknown sequence, the hybrid length is assumed to be that of the hybridizing nucleic acid. When nucleic acids of known sequence are hybridized, the hybrid length can be determined by aligning the sequences of the nucleic acids and identifying the region or regions of optimal sequence complementarity. The hybridization temperature for hybrids anticipated to be less than 50 base pairs in length should be 5 to 10° C. less than the melting temperature (Tm) of the hybrid, where Tm is determined according to the following equations. For hybrids less than 18 base pairs in length, Tm (° C.)=2(# of A+T bases)+4(# of G+C bases). For hybrids above 18 base pairs in length, Tm (° C.)=81.5+16.6(log 10 [Na+])+0.41(% G+C)−(600/N), where N is the number of bases in the hybrid, and [Na+] is the concentration of sodium ions in the hybridization buffer ([Na+] for 1×SSC=0.165M). Preferably, each such hybridizing nucleic acid has a length that is at least 15 nucleotides (or more preferably at least 18 nucleotides, or at least 20 nucleotides, or at least 25 nucleotides, or at least 30 nucleotides, or at least 40 nucleotides, or most preferably at least 50 nucleotides), or at least 25% (more preferably at least 50%, or at least 60%, or at least 70%, and most preferably at least 80%) of the length of the nucleic acid of the present invention to which it hybridizes, and has at least 60% sequence identity (more preferably at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, and most preferably at least 99.5%) with the nucleic acid of the present invention to which it hybridizes, where sequence identity is determined by comparing the sequences of the hybridizing nucleic acids when aligned so as to maximize overlap and identity while minimizing sequence gaps as described in more detail above.

Variants of the anti-CGRP receptor antibodies and antigen binding proteins described herein can be prepared by site-specific mutagenesis of nucleotides in the DNA encoding the polypeptide, using cassette or PCR mutagenesis or other techniques well known in the art, such as those described in Example 1, to produce DNA encoding the variant, and thereafter expressing the recombinant DNA in cell culture as outlined herein. Antibodies and antigen binding proteins comprising variant CDRs having up to about 100-150 residues may also be prepared by in vitro synthesis using established techniques. The variants typically exhibit the same qualitative biological activity as the naturally occurring analogue, e.g., binding to antigen. Such variants include, for example, deletions and/or insertions and/or substitutions of residues within the amino acid sequences of the antibodies or antigen binding proteins. Any combination of deletion, insertion, and substitution is made to arrive at the final construct, provided that the final construct possesses the desired characteristics. The amino acid changes also may alter post-translational processes of the antibody or antigen binding protein, such as changing the number or position of glycosylation sites. In certain embodiments, variants of the anti-CGRP receptor antibodies and antigen binding proteins are prepared with the intent to modify those amino acid residues which are directly involved in epitope binding. In other embodiments, modification of residues which are not directly involved in epitope binding or residues not involved in epitope binding in any way, is desirable, for purposes discussed herein. Mutagenesis within any of the CDR regions and/or framework regions is contemplated. Covariance analysis techniques can be employed by the skilled artisan to design useful modifications in the amino acid sequence of the antibody or antigen binding protein. See, e.g., Choulier, et al., Proteins 41:475-484, 2000; Demarest et al., J. Mol. Biol. 335:41-48, 2004; Hugo et al., Protein Engineering 16(5):381-86, 2003; US Patent Publication No. 2008/0318207; US Patent Publication No. 2009/0048122; WO 2008/110348; and WO 2009/000099. Such modifications determined by covariance analysis can improve potency, pharmacokinetic, pharmacodynamic, and/or manufacturability characteristics of an antibody or antigen binding protein.

Table 9 shows exemplary nucleic acid sequences encoding light and heavy chain variable regions of anti-CGRP receptor antibodies, and Table 10 shows exemplary nucleic acid sequences encoding light and heavy chain variable regions of anti-PAC1 receptor antibodies. Polynucleotides encoding the anti-CGRP receptor variable regions can be used, optionally with nucleic acids encoding the light and heavy chain constant regions listed in Tables 3 and 4, respectively, to construct the anti-CGRP receptor antibodies and antigen-binding fragments of the invention. Polynucleotides encoding the anti-CGRP receptor and anti-PAC1 receptor variable regions can also be used to construct the anti-CGRP receptor and anti-PAC1 receptor binding domains, respectively, of the bispecific antigen binding proteins (e.g. heterodimeric antibodies) described herein. Tables 5A and 5B show exemplary nucleic acid sequences encoding the full light and heavy chains, respectively, of anti-CGRP receptor antibodies described herein. Tables 7A and 7B show exemplary nucleic acid sequences encoding the full light and heavy chains, respectively, of anti-PAC1 receptor antibodies described herein. Polynucleotides encoding anti-CGRP receptor antibody light and heavy chains can be co-expressed with polynucleotides encoding anti-PAC1 receptor antibody light and heavy chains to produce bispecific antigen binding proteins, such as heterodimeric antibodies, of the invention.

TABLE 9

| Exemplary Anti-CGRP Receptor Antibody Variable Region Nucleic Acid Sequences | | | |
|---|---|---|---|
| Antibody ID | Designation | Nucleic Acid Sequence | SEQ ID NO: |
| | | Light chain variable regions | |
| 4E4, 03, 03A, 03B | LV-01 | CAGTCTGTGTTGACGCAGCCGCCCTCAGTGTCTGCGGCCCCAGGACAGAAGGTCACCATCTCCTGCTCTGGAAGCAGCTCCAACATTGGGAATAATTATGTATCCTGGTACCAGCAGCTCCCAGGAACAGCCCCCAAACTCCTCATTTATGACAATAATAAGCGACCCTCAGGGATTCCTGACCGATTCTCTGGCTCCAAGTCTGGCACGTCAACCACCCTGGGCATCACCGGACTCCAGACTGGGGACGAGGCCGATTATTACTGCGGAACATGGGATAGCCGCCTGAGTGCTGTGGTTTTCGGCGGAGGGACCAAGCTGACCGTCCTAGGT | 393 |
| 4E4.2, 04, 07, 09, 10 | LV-02 | CAGTCTGTGTTGACGCAGCCGCCCTCAGTGTCTGCGGCCCCAGGACAGAAGGTCACCATCTCCTGCTCTGGAAGCAGCTCCAACATTGGGAATAATTATGTATCCTGGTACCAGCAGCTCCCAGGAACAGCCCCCAAACTCCTCATTTATGACAATAATAAGCGACCCTCAGGGATTCCTGACCGATTCTCTGGCTCCAAGTCTGGCACGTCAGCCACCCTGGGCATCACCGGACTCCAGACTGGGGACGAGGCCGATTATTACTGCGGAACATGGGATAGCCGCCTGAGTGCTGTGGTTTTCGGCGGAGGGACCAAGCTGACCGTCCTAGGT | 394 |
| 01, 01A, 01B, 01C, 01D, 01E, 01F, 01G | LV-03 | CAGTCTGTGTTGACGCAGCCGCCCTCAGTGTCTGCGGCCCCAGGACAGAAGGTCACCATCTCCTGCTCTGGAAGCTACTCCAACATTGGGCGTTACTCTGTATCCTGGTACCAGCAGCTCCCAGGAACAGCCCCCAAACTCCTCATTTATGACAATAATAAGCGACCCTCAGGGATTCCTGACCGATTCTCTGGCTCCAAGTCTGGCACGTCAGCCACCCTGGGCATCACCGGACTCCAGACTGGGGACGAGGCCGATTATTACTGCGGAACATGGGATAGCCGCCTGAGTGCTGTGGTTTTCGGCGGAGGGACCAAGCTGACCGTCCTAGGT | 395 |
| 02, 02A, 02B | LV-04 | CAGTCTGTGTTGACGCAGCCGCCCTCAGTGTCTGCGGCCCCAGGACAGAAGGTCACCATCTCCTGCTCTGGAAGCCGTTCCAACATTGGGATCAAAGCTGTATCCTGGTACCAGCAGCTCCCAGGAACAGCCCCCAAACTCCTCATTTATGACAATAATAAGCGACCCTCAGGGATTCCTGACCGATTCTCTGGCTCCAAGTCTGGCACGTCAGCCACCCTGGGCATCACCGGACTCCAGACTGGGGACGAGGCCGATTATTACTGCGGAACATGGGATAGCCGCCTGAGTGCTGTGGTTTTCGGCGGAGGGACCAAGCTGACCGTCCTAGGT | 396 |
| 05 | LV-05 | CAGTCTGTGTTGACGCAGCCGCCCTCAGTGTCTGCGGCCCCAGGACAGAAGGTCACCATCTCCTGCTCTGGAAGCTTCTCCAACATTGGGCGTTCTACTGTATCCTGGTACCAGCAGCTCCCAGGAACAGCCCCCAAACTCCTCATTTATGACAATCGTTGGCGCGCGGGTGGGATTCCTGACCGATTCTCTGGCTCCAAGTCTGGCACGTCAGCCACCCTGGGCATCACCGGACTCCAGACTGGGGACGAGGCCGATTATTACTGCGGAACATGGGATTACCAGTGGAAAGCTGTGGTTTTCGGCGGAGGGACCAAGCTGACCGTCCTAGGT | 397 |
| 06 | LV-06 | CAGTCTGTGTTGACGCAGCCGCCCTCAGTGTCTGCGGCCCCAGGACAGAAGGTCACCATCTCCTGCTCTGGAAGCTACTCCAACATTGGGCGTAAATCTGTATCCTGGTACCAGCAGCTCCCAGGAACAGCCCCCAAACTCCTCATTTATGACAATAATAAGCGACCCTCAGGGATTCCTGACCGATTCTCTGGCTCCAAGTCTGGCACGTCAGCCACCCTGGGCATCACCGGACTCCAGACTGGGGACGAGGCCGATTATTACTGCGGAACATGGGATAGCCGCCTGAGTGCTGTGGTTTTCGGCGGAGGGACCAAGCTGACCGTCCTAGGT | 398 |
| 08 | LV-07 | CAGTCTGTGTTGACGCAGCCGCCCTCAGTGTCTGCGGCCCCAGGACAGAAGGTCACCATCTCCTGCTCTGGAAGCTACTCCAACATTGGGTGGTGGCCGGTATCCTGGTACCAGCAGCTCCCAGGAACAGCCCCCAAACTCCTCATTTATGACAATAATAAGCGACCCTCAGGGATTCCTGACCGATTCTCTGGCTCCAAGTCTGGCACGTCAGCCACCCTGGGCATCACCGGACTCCAGACTGGGGACGAGGCCGATTATTACTGCGGAACATGGGATAGCCGCCTGAGTGCTGTGGTTTTCGGCGGAGGGACCAAGCTGACCGTCCTAGGT | 399 |
| 11 | LV-08 | CAGTCTGTGTTGACGCAGCCGCCCTCAGTGTCTGCGGCCCCAGGACAGAAGGTCACCATCTCCTGCTCTGGAAGCCGTTCCAACATTGGGCGTTACTCTGTATCCTGGTACCAGCAGCTCCCAGGAACAGCCCCCAAACTCCTCATTTATGAAAATATGTTCCGCCCGCGTGGGATTCCTGACCGATTCTCTGGCTCCAAGTCTGGCACGTCAGCCACCCTGGGCATCACCGGACTCCAGACTGGGGACGAGGCCGATTATTACTGCGGAACATGGGATTACCGTATGCAGGCTGTGGTTTTCGGCGGAGGGACCAAGCTGACCGTCCTAGGT | 400 |

TABLE 9-continued

Exemplary Anti-CGRP Receptor Antibody Variable Region Nucleic Acid Sequences

| Antibody ID | Designation | Nucleic Acid Sequence | SEQ ID NO: |
|---|---|---|---|
| 12 | LV-09 | CAGTCTGTGTTGACGCAGCCGCCCTCAGTGTCTGCGGCCCCAGGAC AGAAGGTCACCATCTCCTGCTCTGGAAGCCGTTCCAACATTGGGC GTTACTCTGTATCCTGGTACCAGCAGCTCCCAGGAACAGCCCCCAA ACTCCTCATTTATGACAATCGTTACCGCGCGCAGGGGATTCCTGAC CGATTCTCTGGCTCCAAGTCTGGCACGTCAGCCACCCTGGGCATCA CCGGACTCCAGACTGGGGACGAGGCCGATTATTACTGCGGAACAT GGGATTGGGCTACTACTTCTGTGGTTTTCGGCGGAGGGACCAAGCT GACCGTCCTAGGT | 401 |
| 13 | LV-10 | CAGTCTGTGTTGACGCAGCCGCCCTCAGTGTCTGCGGCCCCAGGAC AGAAGGTCACCATCTCCTGCTCTGGAAGCCGTTCCAACATTGGGC GTCGTACTGTATCCTGGTACCAGCAGCTCCCAGGAACAGCCCCCA AACTCCTCATTTATGACAATAATAAGCGACCCTCAGGGATTCCTGA CCGATTCTCTGGCTCCAAGTCTGGCACGTCAGCCACCCTGGGCATC ACCGGACTCCAGACTGGGGACGAGGCCGATTATTACTGCGGAACA TGGGATAGCCGCCTGAGTGCTGTGGTTTTCGGCGGAGGGACCAAG CTGACCGTCCTAGGT | 402 |
| 14 | LV-11 | CAGTCTGTGTTGACGCAGCCGCCCTCAGTGTCTGCGGCCCCAGGAC AGAAGGTCACCATCTCCTGCTCTGGAAGCAGCTCCAACATTGGGA ATAATTATGTATCCTGGTACCAGCAGCTCCCAGGAACAGCCCCCA AACTCCTCATTTATGACAATAATAAGCGACCCTCAGGGATTCCTGA CCGATTCTCTGGCTCCAAGTCTGGCACGTCAGCCACCCTGGGCATC ACCGGACTCCAGACTGGGGACGAGGCCGATTATTACTGCGGAACA TGGGATTCTTGGCATCGTGTTGTGACTTTCGGCGGAGGGACCAAGC TGACCGTCCTAGGT | 403 |
| 15 | LV-12 | CAGTCTGTGTTGACGCAGCCGCCCTCAGTGTCTGCGGCCCCAGGAC AGAAGGTCACCATCTCCTGCTCTGGAAGCAGCTCCAACATTGGGA ATAATTATGTATCCTGGTACCAGCAGCTCCCAGGAACAGCCCCCA AACTCCTCATTTATGACAATAATAAGCGACCCTCAGGGATTCCTGA CCGATTCTCTGGCTCCAAGTCTGGCACGTCAGCCACCCTGGGCATC ACCGGACTCCAGACTGGGGACGAGGCCGATTATTACTGCGGAACA TGGGATTGGTGGCGTAAAGCTGTGATTTTCGGCGGAGGGACCAAG CTGACCGTCCTAGGT | 404 |
| | | Heavy chain variable regions | |
| 4E4 | HV-01 | CAGGTGCAGCTGGTGGAATCTGGGGGAGGCGTGGTCCAGCCTGGG AGGTCCCTGAGACTCTCCTGTGCAGCCTCTGGATTCACCTTCAGTA GCTTTGGCATGCACTGGGTCCGCCAGGCTCCAGGCAAGGGGCTGG AGTGGGTGGCAGTTATATCATTTGATGGAAGTATTAAGTATTCTGT AGACTCCGTGAAGGGCCGATTCACCATCTCCAGAGACAATTCAAA GAACACGCTGTTTCTGCAAATGAACAGCCTGCGAGCCGAGGACAC GGCTGTGTATTACTGTGCGAGAGATCGGCTCAATTACTATGATAGT AGTGGTTATTATCACTACAAATACTACGGTATGGCCGTCTGGGGCC AAGGGACCACGGTCACCGTCTCTAGT | 405 |
| 4E4.2, 01, 01A, 01B, 01C, 01D, 01E, 01F, 01G, 02, 02A, 02B, 05, 06, 08, 12, 13, 14, 15 | HV-02 | CAGGTGCAGCTGGTGGAATCTGGGGGAGGCGTGGTCCAGCCTGGG AGGTCCCTGAGACTCTCCTGTGCAGCCTCTGGATTCACCTTCAGTA GCTTTGGCATGCACTGGGTCCGCCAGGCTCCAGGCAAGGGGCTGG AGTGGGTGGCAGTTATATCATTTGATGGAAGTATTAAGTATTCTGT AGACTCCGTGAAGGGCCGATTCACCATCTCCAGAGACAATTCAAA GAACACGCTGTTTCTGCAAATGAACAGCCTGCGAGCCGAGGACAC GGCTGTGTATTACTGTGCGAGAGATCGGCTCAATTACTATGAGAGT AGTGGTTATTATCACTACAAATACTACGGTATGGCCGTCTGGGGCC AAGGGACAACAGTTACCGTCTCTAGT | 406 |
| 03, 03A, 03B, 04 | HV-03 | CAGGTGCAGCTGGTGGAATCTGGGGGAGGCGTGGTCCAGCCTGGG AGGTCCCTGAGACTCTCCTGTGCAGCCTCTGGATTCACCTTCAGTA GCTTTGGCATGCACTGGGTCCGCCAGGCTCCAGGCAAGGGGCTGG AGTGGGTGGCAGTTATATCATTTGATGGAAGTATTAAGTATTCTGT AGACTCCGTGAAGGGCCGATTCACCATCTCCAGAGACAATTCAAA GAACACGCTGTTTCTGCAAATGAACAGCCTGCGAGCCGAGGACAC GGCTGTGTATTACTGTGCGAGAGATCGGCTCAACTACTATCGTAGT TTCGGTTATTATGGTTACCATTACTACGGTATGGCCGTCTGGGGCC AAGGGACAACAGTTACCGTCTCTAGT | 407 |
| 07 | HV-04 | CAGGTGCAGCTGGTGGAATCTGGGGGAGGCGTGGTCCAGCCTGGG AGGTCCCTGAGACTCTCCTGTGCAGCCTCTGGATTCTACTTCATGA CTTATGGTATGCACTGGGTCCGCCAGGCTCCAGGCAAGGGGCTGG AGTGGGTGGCAGTTATATCATTTGATGGGAGTATTAAGTATTCTGT | 408 |

TABLE 9-continued

Exemplary Anti-CGRP Receptor Antibody Variable Region Nucleic Acid Sequences

| Antibody ID | Designation | Nucleic Acid Sequence | SEQ ID NO: |
|---|---|---|---|
| | | AGACTCCGTGAAGGGCCGATTCACCATCTCCAGAGACAATTCAAA<br>GAACACGCTGTTTCTGCAAATGAACAGCCTGCGAGCCGAGGACAC<br>GGCTGTGTATTACTGTGCGAGAGATCGGCTCAATTACTATGAGAGT<br>AGTGGTTATTATCACTACAAATACTACGGTATGGCCGTCTGGGGCC<br>AAGGGACAACAGTTACCGTCTCTAGT | |
| 09 | HV-05 | CAGGTGCAGCTGGTGGAATCTGGGGGAGGCGTGGTCCAGCCTGGG<br>AGGTCCCTGAGACTCTCCTGTGCAGCCTCTGGATTCACCTTCAGTA<br>GCTTTGGCATGCACTGGGTCCGCCAGGCTCCAGGCAAGGGGCTGG<br>AGTGGGTGGCAGTTATATCATTTGCTGGAGAAATCGACTACTACGT<br>AGACTCCGTGAAGGGCCGATTCACCATCTCCAGAGACAATTCAAA<br>GAACACGCTGTTTCTGCAAATGAACAGCCTGCGAGCCGAGGACAC<br>GGCTGTGTATTACTGTGCGAGAGATCGGCTCAATTACTATGAGAGT<br>AGTGGTTATTATCACTACAAATACTACGGTATGGCCGTCTGGGGCC<br>AAGGGACAACAGTTACCGTCTCTAGT | 409 |
| 10 | HV-06 | CAGGTGCAGCTGGTGGAATCTGGGGGAGGCGTGGTCCAGCCTGGG<br>AGGTCCCTGAGACTCTCCTGTGCAGCCTCTGGATTCTTCTTCGGTT<br>CTTATGGTATGCACTGGGTCCGCCAGGCTCCAGGCAAGGGGCTGG<br>AGTGGGTGGCAGTTATATCATTTGCTGGAGAAATCGAACATTACG<br>TAGACTCCGTGAAGGGCCGATTCACCATCTCCAGAGACAATTCAA<br>AGAACACGCTGTTTCTGCAAATGAACAGCCTGCGAGCCGAGGACA<br>CGGCTGTGTATTACTGTGCGAGAGATCGGCTCAATTACTATGAGA<br>GTAGTGGTTATTATCACTACAAATACTACGGTATGGCCGTCTGGGG<br>CCAAGGGACAACAGTTACCGTCTCTAGT | 410 |
| 11 | HV-07 | CAGGTGCAGCTGGTGGAATCTGGGGGAGGCGTGGTCCAGCCTGGG<br>AGGTCCCTGAGACTCTCCTGTGCAGCCTCTGGATTCTGGTTCGACA<br>CTTTTGGTATGCACTGGGTCCGCCAGGCTCCAGGCAAGGGGCTGG<br>AGTGGGTGGCAGTTATATCATTTGCTGGAGAAGACACTCATTACGT<br>AGACTCCGTGAAGGGCCGATTCACCATCTCCAGAGACAATTCAAA<br>GAACACGCTGTTTCTGCAAATGAACAGCCTGCGAGCCGAGGACAC<br>GGCTGTGTATTACTGTGCGAGAGATCGGCTCAACTACTATGAAAG<br>TTACGGTTATTATGGTTACCATTACTACGGTATGGCCGTCTGGGGC<br>CAAGGGACAACAGTTACCGTCTCTAGT | 411 |

TABLE 10

Exemplary Anti-PAC1 Receptor Antibody Variable Region Nucleic Acid Sequences

| Antibody ID | Designation | Nucleic Acid Sequence | SEQ ID NO: |
|---|---|---|---|
| | | Light chain variable regions | |
| 29G4v22 | LV-101 | GATATCCAGCTCACTCAATCGCCATCATTTCTCTCCGCTTCGGTAG<br>GCGACCGGGTCACGATCACATGCAGGGCGTCGCAAAGCATTGGGA<br>GGTCGTTGCATTGGTATCAGCAGAAACCCGGAAAGGCCCCGAAAC<br>TTCTGATCAAATACGCATCACAAAGCTTGAGCGGTGTGCCGTCGC<br>GCTTCTCCGGTTCCGGAAGCGGAACGGAATTCACGCTTACAATCTC<br>CTCACTGCAGCCCGAGGATTTCGCGACCTATTACTGTCACCAGTCA<br>TCCAGACTCCCGTTTACTTTTGGCCCTGGGACCAAGGTGGACATTA<br>AGCGTAC | 412 |
| 101A, 101B, 101C, 101D, 101E, 101F, 101G, 102A, 102B, 102C, 102D, 123A, 123B, 124A, 124B, 125A, 125B, 126A, 126B, 127A, 127B, 131A, 131B, 132A, 132B | LV-102 | GAGATCGTACTTACTCAGTCACCCGCCACATTGTCCCTGAGCCCGG<br>GTGAACGGGCGACCCTCAGCTGCCGAGCATCCAAGTCCGTCGGAC<br>GATCATTGCACTGGTACCAACAAAAACCGGGCCAGGCCCCCAGAC<br>TTCTGATCAAGTATGCGTCACAGAGCTTGTCGGGTATTCCCGCTCG<br>CTTTTCGGGGTCGGGATCCGGGACAGATTTCACGCTCACAATCTCC<br>TCGCTGGAACCCGAGGACTTCGCGGTCTACTATTGTCATCAGTCAT<br>CGAGGTTGCCTTTCACGTTTGGACCAGGGACCAAGGTGGACATTA<br>AG | 413 |

TABLE 10-continued

Exemplary Anti-PAC1 Receptor Antibody Variable Region Nucleic Acid Sequences

| Antibody ID | Designation | Nucleic Acid Sequence | SEQ ID NO: |
|---|---|---|---|
| 103A, 103B, 104A, 104B, 105A, 105B, 106A, 106B, 107A, 107B, 109A, 109B, 110A, 110B, 111A, 111B, 116A, 116B | LV-103 | GAGATCGTACTTACTCAGTCACCCGCCACATTGTCCCTGAGCCCGG GTGAACGGGCGACCCTCAGCTGCCGAGCATCCAAATCCGTCGGGT GGAGCTTGCACTGGTACCAACAAAAACCGGGCCAGGCCCCCAGAC TTCTGATCAAGTATGCGTCACAGAGCTTGTCGGGTATTCCCGCTCG CTTTTCGGGGTCGGGATCCGGGACAGATTTCACGCTCACAATCTCC TCGCTGGAACCCGAGGACTTCGCGGTCTACTATTGTCATCAGTCAT CGAGGTTGCCTTTCACGTTTGGACCAGGGACCAAGGTGGACATTA AGCGTA | 414 |
| 108A, 108B | LV-104 | GAGATCGTACTTACTCAGTCACCCGCCACATTGTCCCTGAGCCCGG GTGAACGGGCGACCCTCAGCTGCCGAGCATCCAAATCCGTCGGGT ACAGCTTGCACTGGTACCAACAAAAACCGGGCCAGGCCCCCAGAC TTCTGATCAAGTATGCGTCACAGAGCTTGTCGGGTATTCCCGCTCG CTTTTCGGGGTCGGGATCCGGGACAGATTTCACGCTCACAATCTCC TCGCTGGAACCCGAGGACTTCGCGGTCTACTATTGTCATCAGTCAT CGAGGTTGCCTTTCACGTTTGGACCAGGGACCAAGGTGGACATTA AGCGTA | 415 |
| 112A, 112B | LV-105 | GAGATCGTACTTACTCAGTCACCCGCCACATTGTCCCTGAGCCCGG GTGAACGGGCGACCCTCAGCTGCCGAGCATCCAAAGCCGTCGGGT GGAGCTTGCACTGGTACCAACAAAAACCGGGCCAGGCCCCCAGAC TTCTGATCAAGTATGCGTCACAGAGCTTGTCGGGTATTCCCGCTCG CTTTTCGGGGTCGGGATCCGGGACAGATTTCACGCTCACAATCTCC TCGCTGGAACCCGAGGACTTCGCGGTCTACTATTGTCATCAGTCAT CGAGGTTGCCTTTCACGTTTGGACCAGGGACCAAGGTGGACATTA AGCGTA | 416 |
| 113A, 113B, 114A, 114B, 117A, 117B, 118A, 118B, 119A, 119B | LV-106 | GAGATCGTACTTACTCAGTCACCCGCCACATTGTCCCTGAGCCCGG GTGAACGGGCGACCCTCAGCTGCCGAGCATCCAAATCAGTCGGTC AGTCTTTGCACTGGTACCAACAAAAACCGGGCCAGGCCCCCAGAC TTCTGATCAAGTATGCGTCACAGAGCTTGTCGGGTATTCCCGCTCG CTTTTCGGGGTCGGGATCCGGGACAGATTTCACGCTCACAATCTCC TCGCTGGAACCCGAGGACTTCGCGGTCTACTATTGTCATCAGTCAT CGCGTTTGCCTTTCACGTTTGGACCAGGGACCAAGGTGGACATTAA GCGT | 417 |
| 115A, 115B | LV-107 | GAGATCGTACTTACTCAGTCACCCGCCACATTGTCCCTGAGCCCGG GTGAACGGGCGACCCTCAGCTGCCGAGCATCCCGTTCAGTCGGTC TGGCTTTGCACTGGTACCAACAAAAACCGGGCCAGGCCCCCAGAC TTCTGATCAAGTATGCGTCACAGAGCTTGTCGGGTATTCCCGCTCG CTTTTCGGGGTCGGGATCCGGGACAGATTTCACGCTCACAATCTCC TCGCTGGAACCCGAGGACTTCGCGGTCTACTATTGTCATCAGTCAT CGTTCTTGCCTTTCACGTTTGGACCAGGGACCAAGGTGGACATTAA GCGTA | 418 |
| 120A, 120B | LV-108 | GAGATCGTACTTACTCAGTCACCCGCCACATTGTCCCTGAGCCCGG GTGAACGGGCGACCCTCAGCTGCCGAGCATCCAAAGCAGTCGGTT TCTCTTTGCACTGGTACCAACAAAAACCGGGCCAGGCCCCCAGAC TTCTGATCAAGTATGCGTCACAGAGCTTGTCGGGTATTCCCGCTCG CTTTTCGGGGTCGGGATCCGGGACAGATTTCACGCTCACAATCTCC TCGCTGGAACCCGAGGACTTCGCGGTCTACTATTGTCATCAGTCAT CGTTCTTGCCTTTCACGTTTGGACCAGGGACCAAGGTGGACATTAA GCGT | 419 |
| 121A, 121B | LV-109 | GAGATCGTACTTACTCAGTCACCCGCCACATTGTCCCTGAGCCCGG GTGAACGGGCGACCCTCAGCTGCCGAGCATCCCGTGCAGTCTCTA ACTTGCACTGGTACCAACAAAAACCGGGCCAGGCCCCCAGACTTC TGATCAAGTATGCGTCACAGAGCTTGTCGGGTATTCCCGCTCGCTT TTCGGGGTCGGGATCCGGGACAGATTTCACGCTCACAATCTCCTCG CTGGAACCCGAGGACTTCGCGGTCTACTATTGTCATCAGTCATCGT ACTTGCCTTTCACGTTTGGACCAGGGACCAAGGTGGACATTAAGC GT | 420 |
| 122A, 122B | LV-110 | GAGATCGTACTTACTCAGTCACCCGCCACATTGTCCCTGAGCCCGG GTGAACGGGCGACCCTCAGCTGCCGAGCATCCAAAGCAGTCTGGC ATAACTTGCACTGGTACCAACAAAAACCGGGCCAGGCCCCCAGAC TTCTGATCAAGTATGCGTCACAGAGCTTGTCGGGTATTCCCGCTCG CTTTTCGGGGTCGGGATCCGGGACAGATTTCACGCTCACAATCTCC TCGCTGGAACCCGAGGACTTCGCGGTCTACTATTGTCATCAGTCAT CGATGTTGCCTTTCACGTTTGGACCAGGGACCAAGGTGGACATTA AGCGT | 421 |

TABLE 10-continued

Exemplary Anti-PAC1 Receptor Antibody Variable Region Nucleic Acid Sequences

| Antibody ID | Designation | Nucleic Acid Sequence | SEQ ID NO: |
|---|---|---|---|
| 128A, 128B, 129A, 129B, 130A, 130B | LV-111 | GAGATCGTACTTACTCAGTCACCCGCCACATTGTCCCTGAGCCCGG GTGAACGGGCGACCCTCAGCTGCCGAGCATCCCAGTCCGTCGGAC GATCATTGCACTGGTACCAACAAAAACCGGGCCAGGCCCCCAGAC TTCTGATCAAGTATGCGTCACAGAGCTTGTCGGGTATTCCCGCTCG CTTTTCGGGGTCGGGATCCGGGACAGATTTCACGCTCACAATCTCC TCGCTGGAACCCGAGGACTTCGCGGTCTACTATTGTCATCAGTCAT CGAGGTTGCCTTTCACGTTTGGACCAGGGACCAAGGTGGACATTA AG | 422 |
| | | Heavy chain variable regions | |
| 29G4v22 | HV-101 | CAAGTTCAGTTGGTGGAGTCTGGAGCCGAAGTAGTAAAGCCAGGA GCTTCAGTGAAAGTCTCTTGTAAAGCAAGTGGATTCACGTTTAGCC GCTTTGCCATGCATTGGGTGCGGCAAGCTCCCGGTCAGGGGTTGG AGTGGATGGGAGTTATTAGCTATGACGGGGGCAATAAGTACTACG CCGAGTCTGTTAAGGGTCGGGTCACAATGACACGGGACACCTCAA CCAGTACACTCTATATGGAACTGTCTAGCCTGAGATCCGAGGACA CCGCTGTGTATTATTGCGCTAGGGGGTACGATGTATTGACGGGTTA TCCTGATTACTGGGGGCAGGGGACACTCGTAACCGTCTCTAGT | 423 |
| 101A, 101B, 101C, 101D, 101E, 101F, 101G | HV-102 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGCAGTTATATCATATCAGGGACGCAATAAATACTATG CAGAGTCCGTGAAGGGCCGGTTCACCATCTCCAGAGACAATTCCA AGAACACCCTGTATCTGCAAATGAACAGCCTGAGAGCTGAGGACA CGGCTCTGTTTTACTGTGCGAGAGGATACGATGTTTTGACTGGTTA CCCCGACTACTGGGGCCAGGGAACCCTGGTCACCGTCTCTAGT | 424 |
| 102A, 102B, 102C, 102D | HV-103 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGCAGTTATATCATATAACGGAGGAAATAAATACTATG CAGAGTCCGTGAAGGGCCGGTTCACCATCTCCAGAGACAATTCCA AGAACACCCTGTATCTGCAAATGAACAGCCTGAGAGCTGAGGACA CGGCTCTGTTTTACTGTGCGAGAGGATACGATGTTTTGACTGGTTA CCCCGACTACTGGGGCCAGGGAACCCTGGTCACCGTCTCTAGT | 425 |
| 103A, 103B | HV-104 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGGTGTTATATCTTTTTCTGGAGGTTCTAAATACTATGC AGAGTCCGTGAAGGGCCGGTTCACCTTGTCCAGAGACAATTCCAA GAACACCCTGTATCTGCAAATGAACAGCCTGAGAGCTGAGGACAC GGCTCTGTTTTACTGTGCGAGAGGATACGATGTTTTGACTGGTTAC CCCGACTACTGGGGCCAGGGAACCCTGGTCACCGTGTCTAGT | 426 |
| 104A, 104B | HV-105 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGGTGTTATCAACTATCGTGGACATGGTAAATACTATG CAGAGTCCGTGAAGGGCCGGTTCACCGTGTCCAGAGACAATTCCA AGAACACCCTGTATCTGCAAATGAACAGCCTGAGAGCTGAGGACA CGGCTCTGTTTTACTGTGCGAGAGGATACGATGTTTTGACTGGTTA CCCCGACTACTGGGGCCAGGGAACCCTGGTCACCGTGTCTAGT | 427 |
| 105A, 105B | HV-106 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGGTGTTATATCTTATTCTGGAGCTTCTAAATACTATGC AGAGTCCGTGAAGGGCCGGTTCACCATGTCCAGAGACAATTCCAA GAACACCCTGTATCTGCAAATGAACAGCCTGAGAGCTGAGGACAC GGCTCTGTTTTACTGTGCGAGAGGATACGATGTTTTGACTGGTTAC CCCGACTACTGGGGCCAGGGAACCCTGGTCACCGTGTCTAGT | 428 |
| 106A, 106B | HV-107 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGCTGTTATATCTTATTCTGGAGCTTTCAAATACTATGC AGAGTCCGTGAAGGGCCGGTTCACCGTGTCCAGAGACAATTCCAA GAACACCCTGTATCTGCAAATGAACAGCCTGAGAGCTGAGGACAC GGCTCTGTTTTACTGTGCGAGAGGATACGATGTTTTGACTGGTTAC CCCGACTACTGGGGCCAGGGAACCCTGGTCACCGTGTCTAGT | 429 |

TABLE 10-continued

Exemplary Anti-PAC1 Receptor Antibody Variable Region Nucleic Acid Sequences

| Antibody ID | Designation | Nucleic Acid Sequence | SEQ ID NO: |
|---|---|---|---|
| 107A, 107B | HV-108 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGGTGTTATATCTTATACTGGAGCTCAGAAATACTATGC AGAGTCCGTGAAGGGCCGGTTCACCATGTCCAGAGACAATTCCAA GAACACCCTGTATCTGCAAATGAACAGCCTGAGAGCTGAGGACAC GGCTCTGTTTTACTGTGCGAGAGGATACGATGTTTTGACTGGTTAC CCCGACTACTGGGGCCAGGGAACCCTGGTCACCGTGTCTAGT | 430 |
| 108A, 108B | HV-109 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGGTGTTATCTCTTATACTGGACAGTTCAAATACTATGC AGAGTCCGTGAAGGGCCGGTTCACCGTGTCCAGAGACAATTCCAA GAACACCCTGTATCTGCAAATGAACAGCCTGAGAGCTGAGGACAC GGCTCTGTTTTACTGTGCGAGAGGATACGATGTTTTGACTGGTTAC CCCGACTACTGGGGCCAGGGAACCCTGGTCACCGTGTCTAGT | 431 |
| 109A, 109B | HV-110 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA AATACGCCATGCACTGGGTCCGCCAGGCTCCAGGCAAGGGGCTGG AGTGGGTGGCAGTTATCTCATACATGGGAGCTAATAAATACTATG CAGAGTCCGTGAAGGGCCGGTTCACCATCTCCAGAGACAATTCCA AGAACACCCTGTATCTGCAAATGAACAGCCTGAGAGCTGAGGACA CGGCTCTGTTTTACTGTGCGAGAGGATACGATCTGCTGACTGGTTA CCCCGACTACTGGGGCCAGGGAACCCTGGTCACCGTGTCTAGT | 432 |
| 110A, 110B | HV-111 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGGTGTTATCAACTTTCAGGGAACTACTAAATACTATGC AGAGTCCGTGAAGGGCCGGTTCACCATCTCCAGAGACAATTCCAA GAACACCCTGTATCTGCAAATGAACAGCCTGAGAGCTGAGGACAC GGCTCTGTTTTACTGTGCGAGAGGATACGATGTTTTGACTGGTTAC CCCGACTACTGGGGCCAGGGAACCCTGGTCACCGTGTCTAGT | 433 |
| 111A, 111B | HV-112 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGGTGTTATATCTTATTCTGGAGATCTGAAATACTATGC AGAGTCCGTGAAGGGCCGGTTCACCGTGTCCAGAGACAATTCCAA GAACACCCTGTATCTGCAAATGAACAGCCTGAGAGCTGAGGACAC GGCTCTGTTTTACTGTGCGAGAGGATACGATGTTTTGACTGGTTAC CCCGACTACTGGGGCCAGGGAACCCTGGTCACCGTGTCTAGT | 434 |
| 112A, 112B | HV-113 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGGTGTTATAACTTATACTGGAGGTGCTAAATACTATGC AGAGTCCGTGAAGGGCCGGTTCACCATCTCCAGAGACAATTCCAA GAACACCCTGTATCTGCAAATGAACAGCCTGAGAGCTGAGGACAC GGCTCTGTTTTACTGTGCGAGAGGATACGATGTTTTGACTGGTTAC CCCGACTACTGGGGCCAGGGAACCCTGGTCACCGTGTCTAGT | 435 |
| 113A, 113B | HV-114 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA AATACGCCATGCACTGGGTCCGCCAGGCTCCAGGCAAGGGGCTGG AGTGGGTGGCAGTTATCTCATACTCTGGAGCTAATAAATACTATGC AGAGTCCGTGAAGGGCCGGTTCACCATCTCCAGAGACAATTCCAA GAACACCCTGTATCTGCAAATGAACAGCCTGAGAGCTGAGGACAC GGCTCTGTTTTACTGTGCGAGAGGATACGATCTGCTGACTGGTTAC CCCGACTACTGGGGCCAGGGAACCCTGGTCACCGTGTCTAGT | 436 |
| 114A, 114B | HV-115 | CAGGTGCAGCTGGTGGAGTCTGGGGGAGGCGTGGTCCAGCCTGGG AGGTCCCTGCGACTCTCCTGTGCAGCCTCTGGATTCACCTTCAGTT ACTACGCCATGCACTGGGTCCGCCAGGCTCCAGGCAAGGGGCTGG AGTGGGTGGCAGTTATCTCACATTACGGAACTAATAAATACTATG CAGAGTCCGTGAAGGGCCGGTTCACCATCTCCAGAGACAATTCCA AGAACACCCTGTATCTGCAAATGAACAGCCTGAGAGCTGAGGACA CGGCTCTGTTTTACTGTGCGAGAGGATACGATCCTCTGACTGGTTA CCCCGACTACTGGGGCCAGGGAACCCTGGTCACCGTGTCTAGT | 437 |

TABLE 10-continued

Exemplary Anti-PAC1 Receptor Antibody Variable Region Nucleic Acid Sequences

| Antibody ID | Designation | Nucleic Acid Sequence | SEQ ID NO: |
|---|---|---|---|
| 115A, 115B | HV-116 | CAGGTGCAGCTGGTGGAGTCTGGGGGAGGCGTGGTCCAGCCTGGG AGGTCCCTGCGACTCTCCTGTGCAGCCTCTGGATTCACCTTCAGTC ATTACGCCATGCACTGGGTCCGCCAGGCTCCAGGCAAGGGGCTGG AGTGGGTGGCAGTTATCTCATACCAGGGAAGTAATAAATACTATG CAGAGTCCGTGAAGGGCCGGTTCACCATCTCCAGAGACAATTCCA AGAACACCCTGTATCTGCAAATGAACAGCCTGAGAGCTGAGGACA CGGCTCTGTTTTACTGTGCGAGAGGATACGATCTGCTGACTGGTTA CCCCGACTACTGGGGCCAGGGAACCCTGGTCACCGTGTCTAGT | 438 |
| 116A, 116B | HV-117 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGGTGTTATCAACTATTTCGGAGACGCTAAATACTATGC AGAGTCCGTGAAGGGCCGGTTCACCATCTCCAGAGACAATTCCAA GAACACCCTGTATCTGCAAATGAACAGCCTGAGAGCTGAGGACAC GGCTCTGTTTTACTGTGCGAGAGGATACGATGTTTTGACTGGTTAC CCCGACTACTGGGGCCAGGGAACCCTGGTCACCGTGTCTAGT | 439 |
| 117A, 117B | HV-118 | CAGGTGCAGCTGGTGGAGTCTGGGGGAGGCGTGGTCCAGCCTGGG AGGTCCCTGCGACTCTCCTGTGCAGCCTCTGGATTCACCTTCAGTT ACTTCGCCATGCACTGGGTCCGCCAGGCTCCAGGCAAGGGGCTGG AGTGGGTGGCAGTTATCTCACATTCTGGAGCTAATAAATACTATGC AGAGTCCGTGAAGGGCCGGTTCACCATCTCCAGAGACAATTCCAA GAACACCCTGTATCTGCAAATGAACAGCCTGAGAGCTGAGGACAC GGCTCTGTTTTACTGTGCGAGAGGATACGATCTGCTGAGTGGTTAC CCCGACTACTGGGGCCAGGGAACCCTGGTCACCGTGTCTAGT | 440 |
| 118A, 118B | HV-119 | CAGGTGCAGCTGGTGGAGTCTGGGGGAGGCGTGGTCCAGCCTGGG AGGTCCCTGCGACTCTCCTGTGCAGCCTCTGGATTCACCTTCAGTT ACTACGCCATGCACTGGGTCCGCCAGGCTCCAGGCAAGGGGCTGG AGTGGGTGGCAGTTATCTCATACTCTGGAAGTAATAAATACTATGC AGAGTCCGTGAAGGGCCGGTTCACCATCTCCAGAGACAATTCCAA GAACACCCTGTATCTGCAAATGAACAGCCTGAGAGCTGAGGACAC GGCTCTGTTTTACTGTGCGAGAGGATACGATCTGCTGACTGGTTAC CCCGACTACTGGGGCCAGGGAACCCTGGTCACCGTGTCTAGT | 441 |
| 119A, 119B | HV-120 | CAGGTGCAGCTGGTGGAGTCTGGGGGAGGCGTGGTCCAGCCTGGG AGGTCCCTGAGACTCTCCTGTGCAGCCTCTGGATTCACCTTCAGTT TCTACGCCATGCACTGGGTCCGCCAGGCTCCAGGCAAGGGGCTGG AGTGGGTGGCAGTTATCTCATCTTTCGGAAGTAATAAATACTATGC AGAGTCCGTGAAGGGCCGGTTCACCATCTCCAGAGACAATTCCAA GAACACCCTGTATCTGCAAATGAACAGCCTGAGAGCTGAGGACAC GGCTCTGTTTTACTGTGCGAGAGGATACGATCTGCTGACTGGTTAC CCCGACTACTGGGGCCAGGGAACCCTGGTCACCGTGTCTAGT | 442 |
| 120A, 120B | HV-121 | CAGGTGCAGCTGGTGGAGTCTGGGGGAGGCGTGGTCCAGCCTGGG AGGTCCCTGCGACTCTCCTGTGCAGCCTCTGGATTCACCTTCAGTC GTTACGCCATGCACTGGGTCCGCCAGGCTCCAGGCAAGGGGCTGG AGTGGGTGGCAGTTATCTCATACTCTGGAGCTAATAAATACTATGC AGAGTCCGTGAAGGGCCGGTTCACCATCTCCAGAGACAATTCCAA GAACACCCTGTATCTGCAAATGAACAGCCTGAGAGCTGAGGACAC GGCTCTGTTTTACTGTGCGAGAGGATACGATCTGCTGAGTGGTTAC CCCGACTACTGGGGCCAGGGAACCCTGGTCACCGTGTCTAGT | 443 |
| 121A, 121B, 123A, 123B | HV-122 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGCAGTTATCTCATATATCGGAGGAAATAAATACTATG CAGAGTCCGTGAAGGGCCGGTTCACCATCTCCAGAGACAATTCCA AGAACACCCTGTATCTGCAAATGAACAGCCTGAGAGCTGAGGACA CGGCTCTGTTTTACTGTGCGAGAGGATACGATGTTTTGACTGGTTA CCCCGACTACTGGGGCCAGGGAACCCTGGTCACCGTGTCTAGT | 444 |
| 122A, 122B | HV-123 | CAGGTGCAGCTGGTGGAGTCTGGGGGAGGCGTGGTCCAGCCTGGG AGGTCCCTGCGACTCTCCTGTGCAGCCTCTGGATTCACCTTCAGTT ACTACGCCATGCACTGGGTCCGCCAGGCTCCAGGCAAGGGGCTGG AGTGGGTGGCAGTTATCTCATCTATGGGAACTAATAAATACTATGC AGAGTCCGTGAAGGGCCGGTTCACCATCTCCAGAGACAATTCCAA GAACACCCTGTATCTGCAAATGAACAGCCTGAGAGCTGAGGACAC GGCTCTGTTTTACTGTGCGAGAGGATACGATGTTTTGACTGGTTAC CCCGACTACTGGGGCCAGGGAACCCTGGTCACCGTGTCTAGT | 445 |

TABLE 10-continued

Exemplary Anti-PAC1 Receptor Antibody Variable Region Nucleic Acid Sequences

| Antibody ID | Designation | Nucleic Acid Sequence | SEQ ID NO: |
|---|---|---|---|
| 124A, 124B | HV-124 | CAGGTGCAGCTGGTGGAGTCTGGGGGAGGCGTGGTCCAGCCTGGG<br>AGGTCCCTGCGACTCTCCTGTGCAGCCTCTGGATTCACCTTCAGTA<br>GATTTGCCATGCACTGGGTCCGCCAGGCTCCAGGCAAGGGGCTGG<br>AGTGGGTGGCAGTTATATCATATAACGGACGCAATAAATACTATG<br>CAGAGTCCGTGAAGGGCCGGTTCACCATCTCCAGAGACAATTCCA<br>AGAACACCCTGTATCTGCAAATGAACAGCCTGAGAGCTGAGGACA<br>CGGCTCTGTTTTACTGTGCGAGAGGATACGATGTTTTGACTGGTTA<br>CCCCGACTACTGGGGCCAGGGAACCCTGGTCACCGTCTCTAGT | 446 |
| 125A, 125B | HV-125 | CAGGTGCAGCTGGTGGAGTCTGGGGGAGGCGTGGTCCAGCCTGGG<br>AGGTCCCTGCGACTCTCCTGTGCAGCCTCTGGATTCACCTTCAGTA<br>GATTTGCCATGCACTGGGTCCGCCAGGCTCCAGGCAAGGGGCTGG<br>AGTGGGTGGCAGTTATATCATATATCGGACGCAATAAATACTATG<br>CAGAGTCCGTGAAGGGCCGGTTCACCATCTCCAGAGACAATTCCA<br>AGAACACCCTGTATCTGCAAATGAACAGCCTGAGAGCTGAGGACA<br>CGGCTCTGTTTTACTGTGCGAGAGGATACGATGTTTTGACTGGTTA<br>CCCCGACTACTGGGGCCAGGGAACCCTGGTCACCGTCTCTAGT | 447 |
| 126A, 126B | HV-126 | CAGGTGCAGCTGGTGGAGTCTGGGGGAGGCGTGGTCCAGCCTGGG<br>AGGTCCCTGCGACTCTCCTGTGCAGCCTCTGGATTCACCTTCAGTA<br>GATTTGCCATGCACTGGGTCCGCCAGGCTCCAGGCAAGGGGCTGG<br>AGTGGGTGGCAGTTATATCATATAACGGAGGAAATAAATACTATG<br>CACGCTCCGTGAAGGGCCGGTTCACCATCTCCAGAGACAATTCCA<br>AGAACACCCTGTATCTGCAAATGAACAGCCTGAGAGCTGAGGACA<br>CGGCTCTGTTTTACTGTGCGAGAGGATACGATGTTTTGACTGGTTA<br>CCCCGACTACTGGGGCCAGGGAACCCTGGTCACCGTCTCTAGT | 448 |
| 127A, 127B | HV-127 | CAGGTGCAGCTGGTGGAGTCTGGGGGAGGCGTGGTCCAGCCTGGG<br>AGGTCCCTGCGACTCTCCTGTGCAGCCTCTGGATTCACCTTCAGTA<br>GATTTGCCATGCACTGGGTCCGCCAGGCTCCAGGCAAGGGGCTGG<br>AGTGGGTGGCAGTTATATCATATTACGGAGGAAATAAATACTATG<br>CACGCTCCGTGAAGGGCCGGTTCACCATCTCCAGAGACAATTCCA<br>AGAACACCCTGTATCTGCAAATGAACAGCCTGAGAGCTGAGGACA<br>CGGCTCTGTTTTACTGTGCGAGAGGATACGATGTTTTGACTGGTTA<br>CCCCGACTACTGGGGCCAGGGAACCCTGGTCACCGTCTCTAGT | 449 |
| 128A, 128B | HV-128 | CAGGTGCAGCTGGTGGAGTCTGGGGGAGGCGTGGTCCAGCCTGGG<br>AGGTCCCTGCGACTCTCCTGTGCAGCCTCTGGATTCACCTTCAGTA<br>GATTTGCCATGCACTGGGTCCGCCAGGCTCCAGGCAAGGGGCTGG<br>AGTGGGTGGCAGTTATATCATATCAGGGACGCAATAAATACTATG<br>CACGCTCCGTGAAGGGCCGGTTCACCATCTCCAGAGACAATTCCA<br>AGAACACCCTGTATCTGCAAATGAACAGCCTGAGAGCTGAGGACA<br>CGGCTCTGTTTTACTGTGCGAGAGGATACGATGTTTTGACTGGTTA<br>CCCCGACTACTGGGGCCAGGGAACCCTGGTCACCGTCTCTAGT | 450 |
| 129A, 129B | HV-129 | CAGGTGCAGCTGGTGGAGTCTGGGGGAGGCGTGGTCCAGCCTGGG<br>AGGTCCCTGCGACTCTCCTGTGCAGCCTCTGGATTCACCTTCAGTA<br>GATTTGCCATGCACTGGGTCCGCCAGGCTCCAGGCAAGGGGCTGG<br>AGTGGGTGGCAGTTATATCATATTACGGACGCAATAAATACTATG<br>CACGCTCCGTGAAGGGCCGGTTCACCATCTCCAGAGACAATTCCA<br>AGAACACCCTGTATCTGCAAATGAACAGCCTGAGAGCTGAGGACA<br>CGGCTCTGTTTTACTGTGCGAGAGGATACGATGTTTTGACTGGTTA<br>CCCCGACTACTGGGGCCAGGGAACCCTGGTCACCGTCTCTAGT | 451 |
| 130A, 130B | HV-130 | CAGGTGCAGCTGGTGGAGTCTGGGGGAGGCGTGGTCCAGCCTGGG<br>AGGTCCCTGCGACTCTCCTGTGCAGCCTCTGGATTCACCTTCAGTA<br>GATTTGCCATGCACTGGGTCCGCCAGGCTCCAGGCAAGGGGCTGG<br>AGTGGGTGGCAGTTATATCATATAACGGAAACAATAAATACTATG<br>CACGCTCCGTGAAGGGCCGGTTCACCATCTCCAGAGACAATTCCA<br>AGAACACCCTGTATCTGCAAATGAACAGCCTGAGAGCTGAGGACA<br>CGGCTCTGTTTTACTGTGCGAGAGGATACGATGTTTTGACTGGTTA<br>CCCCGACTACTGGGGCCAGGGAACCCTGGTCACCGTCTCTAGT | 452 |
| 131A, 131B | HV-131 | CAGGTGCAGCTGGTGGAGTCTGGGGGAGGCGTGGTCCAGCCTGGG<br>AGGTCCCTGCGACTCTCCTGTGCAGCCTCTGGATTCACCTTCAGTA<br>GATTTGCCATGCACTGGGTCCGCCAGGCTCCAGGCAAGGGGCTGG<br>AGTGGGTGGCAGTTATATCATATAACGGACGCAATAAATACTATG<br>CACGCTCCGTGAAGGGCCGGTTCACCATCTCCAGAGACAATTCCA<br>AGAACACCCTGTATCTGCAAATGAACAGCCTGAGAGCTGAGGACA<br>CGGCTCTGTTTTACTGTGCGAGAGGATACGATGTTTTGACTGGTTA<br>CCCCGACTACTGGGGCCAGGGAACCCTGGTCACCGTCTCTAGT | 453 |

TABLE 10-continued

Exemplary Anti-PAC1 Receptor Antibody Variable Region Nucleic Acid Sequences

| Antibody ID | Designation | Nucleic Acid Sequence | SEQ ID NO: |
|---|---|---|---|
| 132A, 132B | HV-132 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGCAGTTATATCATATATCGGACGCAATAAATACTATG CACGCTCCGTGAAGGGCCGGTTCACCATCTCCAGAGACAATTCCA AGAACACCCTGTATCTGCAAATGAACAGCCTGAGAGCTGAGGACA CGGCTCTGTTTTACTGTGCGAGAGGATACGATGTTTTGACTGGTTA CCCCGACTACTGGGGCCAGGGAACCCTGGTCACCGTCTCTAGT | 454 |

Isolated nucleic acids encoding the anti-CGRP receptor antibodies, antigen-binding fragments, or anti-CGRP receptor binding domains of the bispecific antigen binding proteins of the invention may comprise a nucleotide sequence that is at least 80% identical, at least 90% identical, at least 95% identical, or at least 98% identical to any of the nucleotide sequences listed in Tables 5A, 5B, and 9. In some embodiments, an isolated nucleic acid encoding an anti-CGRP receptor antibody light chain variable region comprises a sequence that is at least 80% identical, at least 90% identical, at least 95% identical, or at least 98% identical to a sequence selected from SEQ ID NOs: 393 to 404. In certain embodiments, an isolated nucleic acid encoding an anti-CGRP receptor antibody light chain variable region comprises a sequence selected from SEQ ID NOs: 393 to 404. In related embodiments, an isolated nucleic acid encoding an anti-CGRP receptor antibody heavy chain variable region comprises a sequence that is at least 80% identical, at least 90% identical, at least 95% identical, or at least 98% identical to a sequence selected from SEQ ID NOs: 405 to 411. In other related embodiments, an isolated nucleic acid encoding an anti-CGRP receptor antibody heavy chain variable region comprises a sequence selected from SEQ ID NOs: 405 to 411.

Isolated nucleic acids encoding anti-PAC1 receptor binding domains of the bispecific antigen binding proteins of the invention may comprise a nucleotide sequence that is at least 80% identical, at least 90% identical, at least 95% identical, or at least 98% identical to any of the nucleotide sequences listed in Tables 7A, 7B, and 10. In some embodiments, an isolated nucleic acid encoding an anti-PAC1 receptor antibody light chain variable region comprises a sequence that is at least 80% identical, at least 90% identical, at least 95% identical, or at least 98% identical to a sequence selected from SEQ ID NOs: 412 to 422. In certain embodiments, an isolated nucleic acid encoding an anti-PAC1 receptor antibody light chain variable region comprises a sequence selected from SEQ ID NOs: 412 to 422. In related embodiments, an isolated nucleic acid encoding an anti-PAC1 receptor antibody heavy chain variable region comprises a sequence that is at least 80% identical, at least 90% identical, at least 95% identical, or at least 98% identical to a sequence selected from SEQ ID NOs: 423 to 454. In other related embodiments, an isolated nucleic acid encoding an anti-PAC1 receptor antibody heavy chain variable region comprises a sequence selected from SEQ ID NOs: 423 to 454.

In certain embodiments of the anti-CGRP receptor antibodies of the invention or embodiments in which the bispecific antigen binding protein of the invention is a heterodimeric antibody, an isolated nucleic acid encoding an anti-CGRP receptor antibody light chain may comprise a nucleotide sequence that is at least 80% identical, at least 90% identical, at least 95% identical, or at least 98% identical to any of the nucleotide sequences listed in Table 5A (e.g. SEQ ID NOs: 99 to 114). In some embodiments, the isolated nucleic acid encoding an anti-CGRP receptor antibody light chain of an anti-CGRP receptor antibody or heterodimeric antibody of the invention comprises a sequence selected from SEQ ID NOs: 99 to 114. In these and other embodiments, the isolated nucleic acid encoding an anti-CGRP receptor antibody heavy chain may comprise a nucleotide sequence that is at least 80% identical, at least 90% identical, at least 95% identical, or at least 98% identical to any of the nucleotide sequences listed in Table 5B (e.g. SEQ ID NOs: 115 to 128). In some embodiments, the isolated nucleic acid encoding an anti-CGRP receptor antibody heavy chain of an anti-CGRP receptor antibody or a heterodimeric antibody of the invention comprises a sequence selected from SEQ ID NOs: 115 to 128.

In some embodiments in which the bispecific antigen binding protein of the invention is a heterodimeric antibody, the isolated nucleic acid encoding an anti-PAC1 receptor antibody light chain may comprise a nucleotide sequence that is at least 80% identical, at least 90% identical, at least 95% identical, or at least 98% identical to any of the nucleotide sequences listed in Table 7A (e.g. SEQ ID NOs: 312 to 322). In certain embodiments, the isolated nucleic acid encoding an anti-PAC1 receptor antibody light chain of a heterodimeric antibody of the invention comprises a sequence selected from SEQ ID NOs: 312 to 322. In these and other embodiments, the isolated nucleic acid encoding an anti-PAC1 receptor antibody heavy chain may comprise a nucleotide sequence that is at least 80% identical, at least 90% identical, at least 95% identical, or at least 98% identical to any of the nucleotide sequences listed in Table 7B (e.g. SEQ ID NOs: 323-392). In some embodiments, the isolated nucleic acid encoding an anti-PAC1 receptor antibody heavy chain of a heterodimeric antibody of the invention comprises a sequence selected from SEQ ID NOs: 323 to 392.

The nucleic acid sequences provided in Tables 5A, 5B, 7A, 7B, 9 and 10 are exemplary only. As will be appreciated by those skilled in the art, due to the degeneracy of the genetic code, various nucleic acids may be made, all of which encode the CDRs, variable regions, and heavy and light chains or other components of the antibodies and antigen binding proteins described herein. Thus, having identified a particular amino acid sequence, those skilled in the art could make any number of different nucleic acids, by simply modifying the sequence of one or more codons in a way which does not change the amino acid sequence of the encoded protein.

The present invention also includes vectors comprising one or more nucleic acids encoding one or more components of the anti-CGRP receptor antibodies, antigen-binding fragments, bispecific antigen binding proteins, or binding domains thereof of the invention (e.g. variable regions, light chains, and heavy chains). The term "vector" refers to any molecule or entity (e.g., nucleic acid, plasmid, bacteriophage or virus) used to transfer protein coding information into a host cell. Examples of vectors include, but are not limited to, plasmids, viral vectors, non-episomal mammalian vectors and expression vectors, for example, recombinant expression vectors. The term "expression vector" or "expression construct" as used herein refers to a recombinant DNA molecule containing a desired coding sequence and appropriate nucleic acid control sequences necessary for the expression of the operably linked coding sequence in a particular host cell. An expression vector can include, but is not limited to, sequences that affect or control transcription, translation, and, if introns are present, affect RNA splicing of a coding region operably linked thereto. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals.

A secretory signal peptide sequence can also, optionally, be encoded by the expression vector, operably linked to the coding sequence of interest, so that the expressed polypeptide can be secreted by the recombinant host cell, for more facile isolation of the polypeptide of interest from the cell, if desired. For instance, in some embodiments, signal peptide sequences may be appended/fused to the amino terminus of any of the variable region polypeptide sequences listed in Tables 2A, 2B, 6A, and 6B, or any of the full chain polypeptide sequences listed in Tables 5A, 5B, 7A, and 7B. In certain embodiments, a signal peptide having the amino acid sequence of MDMRVPAQLLGLLLLWLRGARC (SEQ ID NO: 455) is fused to the amino terminus of any of the variable region polypeptide sequences listed in Tables 2A, 2B, 6A, and 6B, or any of the full chain polypeptide sequences listed in Tables 5A, 5B, 7A, and 7B. In other embodiments, a signal peptide having the amino acid sequence of MAWALLLLTLLTQGTGSWA (SEQ ID NO: 456) is fused to the amino terminus of any of the variable region polypeptide sequences listed in Tables 2A, 2B, 6A, and 6B, or any of the full chain polypeptide sequences listed in Tables 5A, 5B, 7A, and 7B. In still other embodiments, a signal peptide having the amino acid sequence of MTCSPLLLTLLIHCTGSWA (SEQ ID NO: 457) is fused to the amino terminus of any of the variable region polypeptide sequences listed in Tables 2A, 2B, 6A, and 6B, or any of the full chain polypeptide sequences listed in Tables 5A, 5B, 7A, and 7B. Other suitable signal peptide sequences that can be fused to the amino terminus of the variable region polypeptide sequences or full chain polypeptide sequences described herein include: MEAPAQLLFLLLLWLPDTTG (SEQ ID NO: 458), MEWTWRVLFLVAAATGAHS (SEQ ID NO: 459), METPAQLLFLLLLWLPDTTG (SEQ ID NO: 460), METPAQLLFLLLLWLPDTTG (SEQ ID NO: 461), MKHLWFFLLLVAAPRWVLS (SEQ ID NO: 462), MEWSWVFLFFLSVTTGVHS (SEQ ID NO: 463), MDIRAPTQLLGLLLLWLPGAKC (SEQ ID NO: 464), MDIRAPTQLLGLLLLWLPGARC (SEQ ID NO: 465), MDTRAPTQLLGLLLLWLPGATF (SEQ ID NO: 466), MDTRAPTQLLGLLLLWLPGARC (SEQ ID NO: 467), METGLRWLLLVAVLKGVQC (SEQ ID NO: 468), METGLRWLLLVAVLKGVQCQE (SEQ ID NO: 469), and MDMRAPTQLLGLLLLWLPGARC (SEQ ID NO: 470). Other signal peptides are known to those of skill in the art and may be fused to any of the variable region polypeptide chains listed in Tables 2A, 2B, 6A, and 6B, or full chain polypeptide chains listed in Tables 5A, 5B, 7A, and 7B, for example, to facilitate or optimize expression in particular host cells.

Typically, expression vectors used in the host cells to produce the anti-CGRP receptor antibodies, antigen-binding fragments, and bispecific antigen proteins (e.g. heterodimeric antibodies) of the invention will contain sequences for plasmid maintenance and for cloning and expression of exogenous nucleotide sequences encoding the components of the antibodies, antigen-binding fragments, and bispecific antigen binding proteins. Such sequences, collectively referred to as "flanking sequences," in certain embodiments will typically include one or more of the following nucleotide sequences: a promoter, one or more enhancer sequences, an origin of replication, a transcriptional termination sequence, a complete intron sequence containing a donor and acceptor splice site, a sequence encoding a leader sequence for polypeptide secretion, a ribosome binding site, a polyadenylation sequence, a polylinker region for inserting the nucleic acid encoding the polypeptide to be expressed, and a selectable marker element. Each of these sequences is discussed below.

Optionally, the vector may contain a "tag"-encoding sequence, i.e., an oligonucleotide molecule located at the 5' or 3' end of the polypeptide coding sequence; the oligonucleotide tag sequence encodes polyHis (such as hexaHis), FLAG, HA (hemaglutinin influenza virus), myc, or another "tag" molecule for which commercially available antibodies exist. This tag is typically fused to the polypeptide upon expression of the polypeptide, and can serve as a means for affinity purification or detection of the polypeptide from the host cell. Affinity purification can be accomplished, for example, by column chromatography using antibodies against the tag as an affinity matrix. Optionally, the tag can subsequently be removed from the purified polypeptide by various means such as using certain peptidases for cleavage.

Flanking sequences may be homologous (i.e., from the same species and/or strain as the host cell), heterologous (i.e., from a species other than the host cell species or strain), hybrid (i.e., a combination of flanking sequences from more than one source), synthetic or native. As such, the source of a flanking sequence may be any prokaryotic or eukaryotic organism, any vertebrate or invertebrate organism, or any plant, provided that the flanking sequence is functional in, and can be activated by, the host cell machinery.

Flanking sequences useful in the vectors of this invention may be obtained by any of several methods well known in the art. Typically, flanking sequences useful herein will have been previously identified by mapping and/or by restriction endonuclease digestion and can thus be isolated from the proper tissue source using the appropriate restriction endonucleases. In some cases, the full nucleotide sequence of a flanking sequence may be known. Here, the flanking sequence may be synthesized using routine methods for nucleic acid synthesis or cloning.

Whether all or only a portion of the flanking sequence is known, it may be obtained using polymerase chain reaction (PCR) and/or by screening a genomic library with a suitable probe such as an oligonucleotide and/or flanking sequence fragment from the same or another species. Where the flanking sequence is not known, a fragment of DNA containing a flanking sequence may be isolated from a larger piece of DNA that may contain, for example, a coding sequence or even another gene or genes. Isolation may be accomplished by restriction endonuclease digestion to produce the proper DNA fragment followed by isolation using agarose gel purification, Qiagen® column chromatography (Chatsworth, CA), or other methods known to the skilled artisan. The selection of suitable enzymes to accomplish this purpose will be readily apparent to one of ordinary skill in the art.

An origin of replication is typically a part of those prokaryotic expression vectors purchased commercially, and the origin aids in the amplification of the vector in a host cell. If the vector of choice does not contain an origin of replication site, one may be chemically synthesized based on a known sequence, and ligated into the vector. For example, the origin of replication from the plasmid pBR322 (New England Biolabs, Beverly, MA) is suitable for most gram-negative bacteria, and various viral origins (e.g., SV40, polyoma, adenovirus, vesicular stomatitus virus (VSV), or papillomaviruses such as HPV or BPV) are useful for cloning vectors in mammalian cells. Generally, the origin of replication component is not needed for mammalian expression vectors (for example, the SV40 origin is often used only because it also contains the virus early promoter).

A transcription termination sequence is typically located 3' to the end of a polypeptide coding region and serves to terminate transcription. Usually, a transcription termination sequence in prokaryotic cells is a G-C rich fragment followed by a poly-T sequence. While the sequence is easily cloned from a library or even purchased commercially as part of a vector, it can also be readily synthesized using known methods for nucleic acid synthesis.

A selectable marker gene encodes a protein necessary for the survival and growth of a host cell grown in a selective culture medium. Typical selection marker genes encode proteins that (a) confer resistance to antibiotics or other toxins, e.g., ampicillin, tetracycline, or kanamycin for prokaryotic host cells; (b) complement auxotrophic deficiencies of the cell; or (c) supply critical nutrients not available from complex or defined media. Specific selectable markers are the kanamycin resistance gene, the ampicillin resistance gene, and the tetracycline resistance gene. Advantageously, a neomycin resistance gene may also be used for selection in both prokaryotic and eukaryotic host cells.

Other selectable genes may be used to amplify the gene that will be expressed. Amplification is the process wherein genes that are required for production of a protein critical for growth or cell survival are reiterated in tandem within the chromosomes of successive generations of recombinant cells. Examples of suitable selectable markers for mammalian cells include dihydrofolate reductase (DHFR) and promoterless thymidine kinase genes. Mammalian cell transformants are placed under selection pressure wherein only the transformants are uniquely adapted to survive by virtue of the selectable gene present in the vector. Selection pressure is imposed by culturing the transformed cells under conditions in which the concentration of selection agent in the medium is successively increased, thereby leading to the amplification of both the selectable gene and the DNA that encodes another gene, such as one or more components of the antibodies, antigen-binding fragments, or bispecific antigen binding proteins described herein. As a result, increased quantities of a polypeptide are synthesized from the amplified DNA.

A ribosome-binding site is usually necessary for translation initiation of mRNA and is characterized by a Shine-Dalgarno sequence (prokaryotes) or a Kozak sequence (eukaryotes). The element is typically located 3' to the promoter and 5' to the coding sequence of the polypeptide to be expressed. In certain embodiments, one or more coding regions may be operably linked to an internal ribosome binding site (IRES), allowing translation of two open reading frames from a single RNA transcript.

In some cases, such as where glycosylation is desired in a eukaryotic host cell expression system, one may manipulate the various pre- or prosequences to improve glycosylation or yield. For example, one may alter the peptidase cleavage site of a particular signal peptide, or add prosequences, which also may affect glycosylation. The final protein product may have, in the −1 position (relative to the first amino acid of the mature protein) one or more additional amino acids incident to expression, which may not have been totally removed. For example, the final protein product may have one or two amino acid residues found in the peptidase cleavage site, attached to the amino-terminus. Alternatively, use of some enzyme cleavage sites may result in a slightly truncated form of the desired polypeptide, if the enzyme cuts at such area within the mature polypeptide.

Expression and cloning vectors of the invention will typically contain a promoter that is recognized by the host organism and operably linked to the molecule encoding the polypeptide. The term "operably linked" as used herein refers to the linkage of two or more nucleic acid sequences in such a manner that a nucleic acid molecule capable of directing the transcription of a given gene and/or the synthesis of a desired protein molecule is produced. For example, a control sequence in a vector that is "operably linked" to a protein coding sequence is ligated thereto so that expression of the protein coding sequence is achieved under conditions compatible with the transcriptional activity of the control sequences. More specifically, a promoter and/or enhancer sequence, including any combination of cis-acting transcriptional control elements is operably linked to a coding sequence if it stimulates or modulates the transcription of the coding sequence in an appropriate host cell or other expression system.

Promoters are non-transcribed sequences located upstream (i.e., 5') to the start codon of a structural gene (generally within about 100 to 1000 bp) that control transcription of the structural gene. Promoters are conventionally grouped into one of two classes: inducible promoters and constitutive promoters. Inducible promoters initiate increased levels of transcription from polynucleotides under their control in response to some change in culture conditions, such as the presence or absence of a nutrient or a change in temperature. Constitutive promoters, on the other hand, uniformly transcribe a gene to which they are operably linked, that is, with little or no control over gene expression. A large number of promoters, recognized by a variety of potential host cells, are well known. A suitable promoter is operably linked to the polynucleotide encoding e.g., heavy chain, light chain, or other component of the antibodies, antigen-binding fragments, and bispecific antigen binding proteins of the invention, by removing the promoter from the source nucleic acid by restriction enzyme digestion and inserting the desired promoter sequence into the vector.

Suitable promoters for use with yeast hosts are also well known in the art. Yeast enhancers are advantageously used with yeast promoters. Suitable promoters for use with mammalian host cells are well known and include, but are not limited to, those obtained from the genomes of viruses such as polyoma virus, fowlpox virus, adenovirus (such as Adenovirus 2), bovine papilloma virus, avian sarcoma virus, cytomegalovirus, retroviruses, hepatitis-B virus and most preferably Simian Virus 40 (SV40). Other suitable mammalian promoters include heterologous mammalian promoters, for example, heat-shock promoters and the actin promoter.

Additional promoters which may be of interest include, but are not limited to: SV40 early promoter (Benoist and Chambon, 1981, Nature 290:304-310); CMV promoter (Thornsen et al., 1984, Proc. Natl. Acad. U.S.A. 81:659-663); the promoter contained in the 3' long terminal repeat of Rous sarcoma virus (Yamamoto et al., 1980, Cell 22:787-797); herpes thymidine kinase promoter (Wagner et al., 1981, Proc. Natl. Acad. Sci. U.S.A. 78: 1444-1445); promoter and regulatory sequences from the metallothionine gene (Prinster et al., 1982, Nature 296:39-42); and prokaryotic promoters, such as the beta-lactamase promoter (Villa-Kamaroff et al., 1978, Proc. Natl. Acad. Sci. U.S.A. 75:3727-3731); or the tac promoter (DeBoer et al., 1983, Proc. Natl. Acad. Sci. U.S.A. 80:21-25). Also of interest are the following animal transcriptional control regions, which exhibit tissue specificity and have been utilized in transgenic animals: the elastase I gene control region that is active in pancreatic acinar cells (Swift et al., 1984, Cell 38:639-646; Ornitz et al., 1986, Cold Spring Harbor Symp. Quant. Biol. 50:399-409; MacDonald, 1987, Hepatology 7:425-515); the insulin gene control region that is active in pancreatic beta cells (Hanahan, 1985, Nature 315: 115-122); the immunoglobulin gene control region that is active in lymphoid cells (Grosschedl et al., 1984, Cell 38:647-658; Adames et al., 1985, Nature 318:533-538; Alexander et al., 1987, Mol. Cell. Biol. 7: 1436-1444); the mouse mammary tumor virus control region that is active in testicular, breast, lymphoid and mast cells (Leder et al., 1986, Cell 45:485-495); the albumin gene control region that is active in liver (Pinkert et al., 1987, Genes and Devel. 1:268-276); the alpha-feto-protein gene control region that is active in liver (Krumlauf et al., 1985, Mol. Cell. Biol. 5: 1639-1648; Hammer et al., 1987, Science 253:53-58); the alpha 1-antitrypsin gene control region that is active in liver (Kelsey et al., 1987, Genes and Devel. 1: 161-171); the beta-globin gene control region that is active in myeloid cells (Mogram et al, 1985, Nature 315:338-340; Kollias et al, 1986, Cell 46:89-94); the myelin basic protein gene control region that is active in oligodendrocyte cells in the brain (Readhead et al., 1987, Cell 48:703-712); the myosin light chain-2 gene control region that is active in skeletal muscle (Sani, 1985, Nature 314:283-286); and the gonadotropic releasing hormone gene control region that is active in the hypothalamus (Mason et al., 1986, Science 234: 1372-1378).

An enhancer sequence may be inserted into the vector to increase transcription of a polynucleotide encoding a component of the antibodies, antigen-binding fragments, or bispecific antigen binding proteins (e.g., light chain, heavy chain, or variable regions) by higher eukaryotes. Enhancers are cis-acting elements of nucleic acid, usually about 10-300 bp in length, that act on the promoter to increase transcription. Enhancers are relatively orientation and position independent, having been found at positions both 5' and 3' to the transcription unit. Several enhancer sequences available from mammalian genes are known (e.g., globin, elastase, albumin, alpha-feto-protein and insulin). Typically, however, an enhancer from a virus is used. The SV40 enhancer, the cytomegalovirus early promoter enhancer, the polyoma enhancer, and adenovirus enhancers known in the art are exemplary enhancing elements for the activation of eukaryotic promoters. While an enhancer may be positioned in the vector either 5' or 3' to a coding sequence, it is typically located at a site 5' from the promoter.

A sequence encoding an appropriate native or heterologous signal sequence (leader sequence or signal peptide) can be incorporated into an expression vector, to promote extracellular secretion of the antibody, antigen-binding fragment, or antigen binding protein as described above. The choice of signal peptide or leader depends on the type of host cells in which the antibody, antigen-binding fragment, or antigen binding protein is to be produced, and a heterologous signal sequence can replace the native signal sequence. Examples of signal peptides are described above. Other signal peptides that are functional in mammalian host cells include the signal sequence for interleukin-7 (IL-7) described in U.S. Pat. No. 4,965,195; the signal sequence for interleukin-2 receptor described in Cosman et al., 1984, Nature 312:768; the interleukin-4 receptor signal peptide described in EP Patent No. 0367 566; the type I interleukin-1 receptor signal peptide described in U.S. Pat. No. 4,968,607; and the type II interleukin-1 receptor signal peptide described in EP Patent No. 0 460 846.

The expression vectors that are provided may be constructed from a starting vector such as a commercially available vector. Such vectors may or may not contain all of the desired flanking sequences. Where one or more of the flanking sequences described herein are not already present in the vector, they may be individually obtained and ligated into the vector. Methods used for obtaining each of the flanking sequences are well known to one skilled in the art. The expression vectors can be introduced into host cells to thereby produce proteins, including antibodies, antigen-binding fragments, and antigen binding proteins, encoded by nucleic acids as described herein.

In certain embodiments, nucleic acids encoding the different components of the anti-CGRP receptor antibodies, antigen-binding fragments, or bispecific antigen binding proteins (e.g. heterodimeric antibodies) of the invention may be inserted into the same expression vector. For instance, the nucleic acid encoding an anti-CGRP receptor antibody light chain can be cloned into the same vector as the nucleic acid encoding an anti-CGRP receptor antibody heavy chain. In such embodiments, the two nucleic acids may be separated by an internal ribosome entry site (IRES) and under the control of a single promoter such that the light chain and heavy chain are expressed from the same mRNA transcript. Alternatively, the two nucleic acids may be under the control of two separate promoters such that the light chain and heavy chain are expressed from two separate mRNA transcripts. In some embodiments in which the bispecific antigen binding protein is a heterodimeric antibody, nucleic acids encoding the anti-CGRP receptor antibody light chain and heavy chain are cloned into one expression vector and the nucleic acids encoding the anti-PAC1 receptor antibody light chain and heavy chain are cloned into a second expression vector. In these and other embodiments in which components of the anti-CGRP receptor antibodies or heterodimeric antibodies are cloned into separate expression vectors, a host cell may be co-transfected with the expression vectors to produce complete anti-CGRP receptor antibodies or heterodimeric antibodies of the invention.

After the vector has been constructed and the one or more nucleic acid molecules encoding the components of the antibodies, antigen-binding fragments, and bispecific antigen binding proteins described herein has been inserted into the proper site(s) of the vector or vectors, the completed vector(s) may be inserted into a suitable host cell for amplification and/or polypeptide expression. Thus, the present invention encompasses an isolated host cell or cell line comprising one or more expression vectors encoding the components of the anti-CGRP receptor antibodies, antigen-binding fragments, or bispecific antigen binding proteins (e.g. heterodimeric antibodies) described herein. The term "host cell" as used herein refers to a cell that has been transformed, or is capable of being transformed, with a nucleic acid and thereby expresses a gene of interest. The term includes the progeny of the parent cell, whether or not the progeny is identical in morphology or in genetic make-up to the original parent cell, so long as the gene of interest is present. A host cell that comprises an isolated nucleic acid of the invention, preferably operably linked to at least one expression control sequence (e.g. promoter or enhancer), is a "recombinant host cell."

The transformation of an expression vector for an anti-CGRP receptor antibody, antigen-binding fragment, or antigen binding protein into a selected host cell may be accomplished by well-known methods including transfection, infection, calcium phosphate co-precipitation, electroporation, microinjection, lipofection, DEAE-dextran mediated transfection, or other known techniques. The method selected will in part be a function of the type of host cell to be used. These methods and other suitable methods are well known to the skilled artisan, and are set forth, for example, in Sambrook et al., 2001, supra.

A host cell, when cultured under appropriate conditions, synthesizes an antibody, antigen-binding fragment, or antigen binding protein that can subsequently be collected from the culture medium (if the host cell secretes it into the medium) or directly from the host cell producing it (if it is not secreted). The selection of an appropriate host cell will depend upon various factors, such as desired expression levels, polypeptide modifications that are desirable or necessary for activity (such as glycosylation or phosphorylation) and ease of folding into a biologically active molecule.

Exemplary host cells include prokaryote, yeast, or higher eukaryote cells. Prokaryotic host cells include eubacteria, such as Gram-negative or Gram-positive organisms, for example, Enterobacteriaceae such as *Escherichia*, e.g., *E. coli, Enterobacter, Erwinia, Klebsiella, Proteus, Salmonella*, e.g., *Salmonella typhimurium, Serratia*, e.g., *Serratia marcescans*, and *Shigella*, as well as *Bacillus*, such as *B. subtilis* and *B. licheniformis, Pseudomonas*, and *Streptomyces*. Eukaryotic microbes such as filamentous fungi or yeast are suitable cloning or expression hosts for recombinant polypeptides. *Saccharomyces cerevisiae*, or common baker's yeast, is the most commonly used among lower eukaryotic host microorganisms. However, a number of other genera, species, and strains are commonly available and useful herein, such as *Pichia*, e.g. *P. pastoris, Schizosaccharomyces pombe; Kluyveromyces, Yarrowia; Candida; Trichoderma reesia; Neurospora crassa; Schwanniomyces*, such as *Schwanniomyces occidentalis*; and filamentous fungi, such as, e.g., *Neurospora, Penicillium, Tolypocladium*, and *Aspergillus* hosts such as *A. nidulans* and *A. niger*.

Host cells for the expression of glycosylated antibodies, antigen-binding fragments, and antigen binding proteins can be derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruitfly), and *Bombyx mori* have been identified. A variety of viral strains for transfection of such cells are publicly available, e.g., the L-1 variant of *Autographa californica* NPV and the Bm-5 strain of *Bombyx mori* NPV.

Vertebrate host cells are also suitable hosts, and recombinant production of antibodies, antigen-binding fragments, and antigen binding proteins from such cells has become routine procedure. Mammalian cell lines available as hosts for expression are well known in the art and include, but are not limited to, immortalized cell lines available from the American Type Culture Collection (ATCC), including but not limited to Chinese hamster ovary (CHO) cells, including CHOK1 cells (ATCC CCL61), DXB-11, DG-44, and Chinese hamster ovary cells/-DHFR (CHO, Urlaub et al., Proc. Natl. Acad. Sci. USA 77: 4216, 1980); monkey kidney CV1 line transformed by SV40 (COS-7, ATCC CRL 1651); human embryonic kidney line (293 or 293 cells subcloned for growth in suspension culture (Graham et al., J. Gen Virol. 36: 59, 1977); baby hamster kidney cells (BHK, ATCC CCL 10); mouse sertoli cells (TM4, Mather, Biol. Reprod. 23: 243-251, 1980); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human hepatoma cells (Hep G2, HB 8065); mouse mammary tumor (MMT 060562, ATCC CCL51); TM cells (Mather et al., Annals N.Y Acad. Sci. 383: 44-68, 1982); MRC 5 cells or FS4 cells; mammalian myeloma cells, and a number of other cell lines. In certain embodiments, cell lines may be selected through determining which cell lines have high expression levels and constitutively produce antibodies and antigen-binding fragments with CGRP receptor binding properties or bispecific antigen binding proteins (e.g. heterodimeric antibodies) with CGRP receptor and PAC1 receptor binding properties. In another embodiment, a cell line from the B cell lineage that does not make its own antibody but has a capacity to make and secrete a heterologous antibody can be selected. CHO cells are preferred host cells in some embodiments for expressing the anti-CGRP receptor antibodies, antigen-binding fragments, and bispecific antigen binding proteins (e.g. heterodimeric antibodies) of the invention.

Host cells are transformed or transfected with the above-described nucleic acids or vectors for production of anti-CGRP receptor antibodies, antigen-binding fragments, or bispecific antigen binding proteins and are cultured in conventional nutrient media modified as appropriate for inducing promoters, selecting transformants, or amplifying the genes encoding the desired sequences. In addition, novel vectors and transfected cell lines with multiple copies of transcription units separated by a selective marker are particularly useful for the expression of antibodies, antigen-binding fragments, and antigen binding proteins. Thus, the present invention also provides a method for producing an anti-CGRP receptor antibody or antigen-binding fragment thereof described herein comprising culturing a host cell comprising one or more expression vectors described herein in a culture medium under conditions permitting expression of the antibody or antigen-binding fragment encoded by the one or more expression vectors; and recovering the antibody or antigen-binding fragment from the culture medium or host cell. In other embodiments, the present invention also includes a method for producing a bispecific antigen binding protein described herein comprising culturing a host cell comprising one or more expression vectors described herein in a culture medium under conditions permitting expression of the bispecific antigen binding protein encoded by the one or more expression vectors; and recovering the bispecific antigen binding protein from the culture medium or host cell.

The host cells used to produce the antibodies, antigen-binding fragments, and antigen binding proteins of the invention may be cultured in a variety of media. Commercially available media such as Ham's F10 (Sigma), Minimal Essential Medium ((MEM), (Sigma), RPMI-1640 (Sigma), and Dulbecco's Modified Eagle's Medium ((DMEM), Sigma) are suitable for culturing the host cells. In addition, any of the media described in Ham et al., Meth. Enz. 58: 44, 1979; Barnes et al., Anal. Biochem. 102: 255, 1980; U.S. Pat. Nos. 4,767,704; 4,657,866; 4,927,762; 4,560,655; or 5,122,469; WO90103430; WO 87/00195; or U.S. Pat. Re. No. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as Gentamycin™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinary skilled artisan.

Upon culturing the host cells, the antibody, antigen-binding fragment, or bispecific antigen binding protein can be produced intracellularly, in the periplasmic space, or directly secreted into the medium. If the antibody, antigen-binding fragment, or antigen binding protein is produced intracellularly, as a first step, the particulate debris, either host cells or lysed fragments, is removed, for example, by centrifugation or ultrafiltration. The antibody, antigen-binding fragment, or bispecific antigen binding protein can be purified from culture medium, culture supernatant or other fluid following a harvest step using, for example, hydroxyapatite chromatography, cation or anion exchange chromatography, or preferably affinity chromatography, using the antigen(s) of interest or protein A or protein G as an affinity ligand. Protein A can be used to purify proteins that include polypeptides that are based on human γ1, γ2, or γ4 heavy chains (Lindmark et al., J. Immunol. Meth. 62: 1-13, 1983). Protein G is recommended for all mouse isotypes and for human γ3 (Guss et al., EMBO J. 5: 15671575, 1986). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the protein comprises a CH3 domain, the Bakerbond ABX™ resin (J. T. Baker, Phillipsburg, N.J.) is useful for purification. Other techniques for protein purification such as ethanol precipitation, Reverse Phase HPLC, chromatofocusing, SDS-PAGE, and ammonium sulfate precipitation are also possible depending on the particular antibody, antigen-binding fragment, or bispecific antigen binding protein to be recovered.

In certain embodiments, the invention provides a composition (e.g. a pharmaceutical composition) comprising one or a plurality of the anti-CGRP receptor antibodies, antigen-binding fragments, or bispecific antigen binding proteins (e.g. heterodimeric antibodies) of the invention together with pharmaceutically acceptable diluents, carriers, excipients, solubilizers, emulsifiers, preservatives, and/or adjuvants. The pharmaceutical compositions can be used in any of the methods described herein. Pharmaceutical compositions of the invention include, but are not limited to, liquid, frozen, and lyophilized compositions. "Pharmaceutically-acceptable" refers to molecules, compounds, and compositions that are non-toxic to human recipients at the dosages and concentrations employed and/or do not produce allergic or adverse reactions when administered to humans. In some embodiments, the pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate 80, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. Methods and suitable materials for formulating molecules for therapeutic use are known in the pharmaceutical arts, and are described, for example, in REMINGTON'S PHARMACEUTICAL SCIENCES, 18th Edition, (A. R. Genrmo, ed.), 1990, Mack Publishing Company.

In some embodiments, the pharmaceutical composition of the invention comprises a standard pharmaceutical carrier, such as a sterile phosphate buffered saline solution, bacteriostatic water, and the like. A variety of aqueous carriers may be used, e.g., water, buffered water, 0.4% saline, 0.3% glycine and the like, and may include other proteins for enhanced stability, such as albumin, lipoprotein, globulin, etc., subjected to mild chemical modifications or the like.

Exemplary concentrations of the antibodies, antigen-binding fragments, or bispecific antigen binding proteins in the formulation may range from about 0.1 mg/mL to about 200 mg/mL or from about 0.1 mg/mL to about 50 mg/mL, or from about 0.5 mg/mL to about 25 mg/mL, or alternatively from about 2 mg/mL to about 10 mg/mL. An aqueous formulation of the antibody, antigen-binding fragment, or antigen binding protein may be prepared in a pH-buffered solution, for example, at pH ranging from about 4.5 to about 6.5, or from about 4.8 to about 5.5, or alternatively about 5.0. Examples of buffers that are suitable for a pH within this range include acetate (e.g. sodium acetate), succinate (such as sodium succinate), gluconate, histidine, citrate and other organic acid buffers. The buffer concentration can be from about 1 mM to about 200 mM, or from about 10 mM to about 60 mM, depending, for example, on the buffer and the desired isotonicity of the formulation.

A tonicity agent, which may also stabilize the antibody, antigen-binding fragment, or antigen binding protein, may be included in the formulation. Exemplary tonicity agents include polyols, such as mannitol, sucrose or trehalose. Preferably the aqueous formulation is isotonic, although hypertonic or hypotonic solutions may be suitable. Exemplary concentrations of the polyol in the formulation may range from about 1% to about 15% w/v.

A surfactant may also be added to the formulation to reduce aggregation of the formulated antibody, antigen-binding fragment, or antigen binding protein and/or minimize the formation of particulates in the formulation and/or reduce adsorption. Exemplary surfactants include nonionic surfactants, such as polysorbates (e.g. polysorbate 20 or polysorbate 80) or poloxamers (e.g. poloxamer 188). Exemplary concentrations of surfactant may range from about 0.001% to about 0.5% w/v, or from about 0.005% to about 0.2% w/v, or alternatively from about 0.004% to about 0.01% w/v.

In one embodiment, the formulation contains the above-identified agents (i.e. antibody, antigen-binding fragment, or antigen binding protein, buffer, polyol and surfactant) and is essentially free of one or more preservatives, such as benzyl alcohol, phenol, m-cresol, chlorobutanol and benzethonium chloride. In another embodiment, a preservative may be included in the formulation, e.g., at concentrations ranging from about 0.1% to about 2%, or alternatively from about 0.5% to about 1%. One or more other pharmaceutically acceptable carriers, excipients or stabilizers such as those described REMINGTON'S PHARMACEUTICAL SCIENCES, 18th Edition, (A. R. Genrmo, ed.), 1990, Mack Publishing Company, may be included in the formulation provided that they do not adversely affect the desired characteristics of the formulation.

Therapeutic formulations of the antibody, antigen-binding fragment, or bispecific antigen binding protein are prepared for storage by mixing the antibody, antigen-binding fragment, or bispecific antigen binding protein having the desired degree of purity with optional physiologically acceptable carriers, excipients or stabilizers (REMINGTON'S PHARMACEUTICAL SCIENCES, 18th Edition, (A. R. Genrmo, ed.), 1990, Mack Publishing Company), in the form of lyophilized formulations or aqueous solutions. Acceptable carriers, excipients, or stabilizers are nontoxic to recipients at the dosages and concentrations employed, and include those described above, such as buffers (e.g. phosphate, citrate, and other organic acids); antioxidants (e.g. ascorbic acid and methionine); preservatives (such as octadecyldimethylbenzyl ammonium chloride, hexamethonium chloride, benzalkonium chloride, benzethonium chloride, phenol, butyl or benzyl alcohol, alkyl parabens such as methyl or propyl paraben, catechol; resorcinol, cyclohexanol, 3-pentanol, and m-cresol); low molecular weight (e.g. less than about 10 residues) polypeptides; proteins (such as serum albumin, gelatin, or immunoglobulins); hydrophilic polymers (e.g. polyvinylpyrrolidone); amino acids (e.g. glycine, glutamine, asparagine, histidine, arginine, or lysine); monosaccharides, disaccharides, and other carbohydrates including glucose, mannose, maltose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants, such as polysorbates (e.g. polysorbate 20 or polysorbate 80) or poloxamers (e.g. poloxamer 188); or polyethylene glycol (PEG).

In one embodiment, a suitable formulation of the invention contains an isotonic buffer such as a phosphate, acetate, or TRIS buffer in combination with a tonicity agent, such as a polyol, sorbitol, sucrose or sodium chloride, which tonicities and stabilizes. One example of such a tonicity agent is 5% sorbitol or sucrose. In addition, the formulation could optionally include a surfactant at 0.01% to 0.02% wt/vol, for example, to prevent aggregation or improve stability. The pH of the formulation may range from 4.5 to 6.5 or 4.5 to 5.5. Other exemplary descriptions of pharmaceutical formulations for antibodies and antigen binding proteins may be found in US Patent Publication No. 2003/0113316 and U.S. Pat. No. 6,171,586, each of which is hereby incorporated by reference in its entirety.

The formulations to be used for in vivo administration must be sterile. The compositions of the invention may be sterilized by conventional, well known sterilization techniques. For example, sterilization is readily accomplished by filtration through sterile filtration membranes. The resulting solutions may be packaged for use or filtered under aseptic conditions and lyophilized, the lyophilized preparation being combined with a sterile solution prior to administration.

The process of freeze-drying is often employed to stabilize polypeptides for long-term storage, particularly when the polypeptide is relatively unstable in liquid compositions. A lyophilization cycle is usually composed of three steps: freezing, primary drying, and secondary drying (see Williams and Polli, Journal of Parenteral Science and Technology, Volume 38, Number 2, pages 48-59, 1984). In the freezing step, the solution is cooled until it is adequately frozen. Bulk water in the solution forms ice at this stage. The ice sublimes in the primary drying stage, which is conducted by reducing chamber pressure below the vapor pressure of the ice, using a vacuum. Finally, sorbed or bound water is removed at the secondary drying stage under reduced chamber pressure and an elevated shelf temperature. The process produces a material known as a lyophilized cake. Thereafter the cake can be reconstituted prior to use. The standard reconstitution practice for lyophilized material is to add back a volume of pure water (typically equivalent to the volume removed during lyophilization), although dilute solutions of antibacterial agents are sometimes used in the production of pharmaceuticals for parenteral administration (see Chen, Drug Development and Industrial Pharmacy, Volume 18: 1311-1354, 1992).

Excipients have been noted in some cases to act as stabilizers for freeze-dried products (see Carpenter et al., Volume 74: 225-239, 1991). For example, known excipients include polyols (including mannitol, sorbitol and glycerol); sugars (including glucose and sucrose); and amino acids (including alanine, glycine and glutamic acid). In addition, polyols and sugars are also often used to protect polypeptides from freezing- and drying-induced damage and to enhance the stability during storage in the dried state. In general, sugars, in particular disaccharides, are effective in both the freeze-drying process and during storage. Other classes of molecules, including mono- and di-saccharides and polymers such as PVP, have also been reported as stabilizers of lyophilized products.

For injection, the pharmaceutical formulation and/or medicament may be a powder suitable for reconstitution with an appropriate solution as described above. Examples of these include, but are not limited to, freeze dried, rotary dried or spray dried powders, amorphous powders, granules, precipitates, or particulates. For injection, the formulations may optionally contain stabilizers, pH modifiers, surfactants, bioavailability modifiers and combinations of these.

Sustained-release preparations may be prepared. Suitable examples of sustained-release preparations include semipermeable matrices of solid hydrophobic polymers containing the antibody, antigen-binding fragment, or bispecific antigen binding protein, which matrices are in the form of shaped articles, e.g., films, or microcapsule. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and y ethyl-L-glutamate, non-degradable ethylene-vinyl acetate, degradable lactic acid-glycolic acid copolymers such as the Lupron Depot™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods. When encapsulated polypeptides remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

The formulations of the invention may be designed to be short-acting, fast-releasing, long-acting, or sustained-releasing as described herein. Thus, the pharmaceutical formulations may also be formulated for controlled release or for slow release.

Specific dosages may be adjusted depending on the disease, disorder, or condition to be treated (e.g. episodic migraine, chronic migraine, or cluster headache), the age, body weight, general health conditions, sex, and diet of the subject, dose intervals, administration routes, excretion rate, and combinations of drugs.

The anti-CGRP receptor antibodies, antigen-binding fragments, or bispecific antigen binding proteins (e.g. heterodimeric antibodies) of the invention can be administered by any suitable means, including parenteral, subcutaneous, intravenous, intraperitoneal, intrapulmonary, and intranasal, and, if desired for local treatment, intralesional administration. Parenteral administration includes intravenous, intraarterial, intraperitoneal, intramuscular, intradermal or subcutaneous administration. In addition, the antibody, antigen-binding fragment, or bispecific antigen binding protein can be administered by pulse infusion, particularly with declining doses of the antibody, antigen-binding fragment, or antigen binding protein. Preferably the dosing is given by injections, most preferably intravenous or subcutaneous injections, depending in part on whether the administration is brief or chronic. Other administration methods are contemplated, including topical, particularly transdermal, transmucosal, rectal, oral or local administration e.g. through a catheter placed close to the desired site. The antibody, antigen-binding fragment, or bispecific antigen binding protein of the invention may be administered in a physiological solution at a dose ranging between 0.01 mg/kg to 100 mg/kg at a frequency ranging from daily to weekly to monthly.

The anti-CGRP receptor antibodies, antigen-binding fragments, and bispecific antigen binding proteins (e.g. heterodimeric antibodies) described herein are useful for treating or ameliorating a condition associated with the biological activity of the CGRP receptor in a patient in need thereof. Thus, anti-CGRP receptor antibodies, antigen-binding fragments, and bispecific antigen binding proteins of the invention for use in the methods of treatment are disclosed herein. As used herein, the term "treating" or "treatment" is an intervention performed with the intention of preventing the development or altering the pathology of a disorder. Accordingly, "treatment" refers to both therapeutic treatment and prophylactic or preventative measures. Those in need of treatment include those already diagnosed with or suffering from the disorder or condition as well as those in which the disorder or condition is to be prevented. "Treatment" includes any indicia of success in the amelioration of an injury, pathology or condition, including any objective or subjective parameter such as abatement, remission, diminishing of symptoms, or making the injury, pathology or condition more tolerable to the patient, slowing in the rate of degeneration or decline, making the final point of degeneration less debilitating, or improving a patient's physical or mental well-being. The treatment or amelioration of symptoms can be based on objective or subjective parameters, including the results of a physical examination, self-reporting by a patient, neuropsychiatric exams, and/or a psychiatric evaluation.

Accordingly, in some embodiments, the present invention provides a method for treating or preventing a condition associated with the biological activity of the CGRP receptor (e.g. a condition associated with CGRP-induced activation of the CGRP receptor) in a patient in need thereof, comprising administering to the patient an effective amount of an anti-CGRP receptor antibody, antigen-binding fragment, or bispecific antigen binding protein (e.g. heterodimeric antibody) described herein. The CGRP/CGRP receptor signaling pathway has been implicated in various physiological processes, including regulation of vasomotor tone, cardiovascular function, inflammation, including neurogenic inflammation, pain transmission, and wound healing. See, e.g., Russell et al., Physiol. Rev., Vol. 94: 1099-1142, 2014. Conditions associated with aberrant or overactivation of the CGRP/CGRP receptor signaling pathway include, but are not limited to, headache conditions, such as migraine, cluster headache, tension-type headache, hemiplegic migraine, menstrual migraine, and retinal migraine; inflammatory skin conditions; chronic pain, such as neuropathic pain, hyperalgesia, fibromyalgia, and allodynia; pain associated with irritable bowel syndrome, Crohn's disease, ulcerative colitis, and interstitial cystitis; arthritis, such as rheumatoid arthritis and osteoarthritis and pain associated with arthritic conditions; overactive bladder; asthma; type II diabetes; and vasomotor symptoms, such as hot flashes, facial flushing, sweating, and night sweats. Thus, the anti-CGRP receptor antibodies, antigen-binding fragments, and bispecific antigen binding proteins of the invention can be administered to patients to prevent, ameliorate, or treat any of these conditions or disorders or other conditions associated with aberrant or excessive CGRP receptor biological activity. In certain embodiments, the present invention provides methods for treating or preventing a headache condition (e.g. episodic migraine, chronic migraine, cluster headache, tension-type headache, hemiplegic migraine, menstrual migraine, and retinal migraine) in a patient in need thereof comprising administering to the patient an effective amount of an anti-CGRP receptor antibody, antigen-binding fragment, or bispecific antigen-binding protein (e.g. heterodimeric antibody) as described herein. In some embodiments, the present invention provides a method for inhibiting activation of the human CGRP receptor in a patient having a headache condition comprising administering to the patient an effective amount of an anti-CGRP receptor antibody, antigen-binding fragment, or bispecific antigen-binding protein (e.g. heterodimeric antibody) described herein. In one such embodiment, the patient has a migraine headache condition, such as episodic migraine or chronic migraine. In another embodiment, the patient has a cluster headache condition.

An "effective amount" is generally an amount sufficient to reduce the severity and/or frequency of symptoms, eliminate the symptoms and/or underlying cause, prevent the occurrence of symptoms and/or their underlying cause, and/or improve or remediate the damage that results from or is associated with a particular condition. In some embodiments, the effective amount is a therapeutically effective amount or a prophylactically effective amount. A "therapeutically effective amount" is an amount sufficient to remedy a disease state or symptom(s), particularly a state or symptom(s) associated with the disease state, or otherwise prevent, hinder, retard or reverse the progression of the disease state or any other undesirable symptom associated with the disease in any way whatsoever (i.e. that provides "therapeutic efficacy"). A "prophylactically effective amount" is an amount, when administered to a subject, will have the intended prophylactic effect, e.g., preventing or delaying the onset (or reoccurrence) of the condition, or reducing the likelihood of the onset (or reoccurrence) of the condition. The full therapeutic or prophylactic effect does not necessarily occur by administration of one dose, and may occur only after administration of a series of doses. Thus, a therapeutically or prophylactically effective amount may be administered in one or more administrations.

In certain embodiments, the present invention provides methods for inhibiting vasodilation in a patient in need thereof comprising administering to the patient an effective amount of an anti-CGRP receptor antibody, antigen-binding fragment, or bispecific antigen binding protein (e.g. heterodimeric antibody) described herein. CGRP, a ligand of the CGRP receptor is a potent vasodilator, and blocking the binding of CGRP to the CGRP receptor can inhibit vasodilation and ameliorate conditions associated with aberrant or excessive vasodilation, such as headache conditions, hot flashes, and flushing. In one embodiment, the patient treated with an anti-CGRP receptor antibody, antigen-binding fragment, or bispecific antigen binding protein of the invention has a headache condition, such as migraine or cluster headache. In another embodiment, the patient treated with an anti-CGRP receptor antibody, antigen-binding fragment, or bispecific antigen binding protein of the invention has vasomotor symptoms (e.g. hot flashes, facial flushing, sweating, or night sweats). In a related embodiment, the patient treated with an anti-CGRP receptor antibody, antigen-binding fragment, or bispecific antigen binding protein has vasomotor symptoms associated with menopause.

In some embodiments of the methods of the invention, the headache condition to be treated, prevented or ameliorated is migraine. Thus, the present invention includes a method for treating, preventing, or ameliorating migraine in a patient in need thereof comprising administering to the patient an effective amount of an anti-CGRP receptor antibody, antigen-binding fragment, or bispecific antigen binding protein (e.g. heterodimeric antibody) described herein. Migraine headaches are recurrent headaches lasting about 4 to about 72 hours that are characterized by unilateral, pulsating, and/or moderate to severe pain and/or pain that is exacerbated by physical activity. Migraine headaches are often accompanied by nausea, vomiting, and/or sensitivity to light (photophobia), sound (phonophobia), or smell. In some patients, an aura precedes the onset of the migraine headache. The aura is typically a visual, sensory, language, or motor disturbance that signals the headache will soon occur. The methods described herein prevent, treat, or ameliorate one or more symptoms of migraine headaches with and without aura in human patients.

Activation of the CGRP receptor and PAC1 receptor by their respective ligands induce vasodilation, particularly vasodilation of the dura vasculature. Both receptor signaling cascades have been implicated in migraine pathophysiology, and are believed to contribute to the induction of migraine through different, but related mechanisms. CGRP released as a result of activation of the trigeminovascular system not only induces vasodilation of the cranial vessels, but also contributes to the induction of neurogenic inflammation, which is a form of inflammation secondary to sensory nerve activation. See, e.g., Bigal et al., Headache, Vol. 53(8):1230-44, 2013 and Russell et al., Physiol. Rev., Vol. 94: 1099-1142, 2014. CGRP also acts as a neurotransmitter to transmit pain signals from the brainstem to the thalamus.

Infusion of PACAP38, which has a higher affinity for the PAC1 receptor than the VPAC1 and VPAC2 receptors, causes migraine-like headache in migraine patients (Schytz et al., Brain 132:16-25, 2009; Amin et al., Brain, Vol. 137: 779-794, 2014; Guo et al., Cephalalgia, Vol. 37:125-135, 2017). In addition, PACAP38 levels are elevated in cranial circulation in patients experiencing a migraine attack, and the PACAP38 levels are reduced following treatment of the migraine symptoms with triptans (Tuka et al., Cephalalgia, Vol. 33, 1085-1095, 2013; Zagami et al., Ann. Clin. Transl. Neurol., Vol. 1: 1036-1040, 2014). These reports suggest that endogenous release of PACAP38 is an important trigger of migraine headache and its effects are primarily mediated through activation of the PAC1 receptor. While CGRP acts primarily through the trigeminal sensory system, the PAC1 receptor and its PACAP ligand are believed to primarily operate through the parasympathetic division of the autonomic nervous system. Immunohistochemistry studies in rat and human tissues mapped PACAP and PAC1 receptor localization to the parasympathetic pathway through the sphenopalatine ganglion (also known as pterygopalatine ganglion), which also innervates the dura vasculature. See Uddman et al., Brain Research, Vol. 826: 193-199, 1999; Steinberg et al., The Journal of Headache and Pain, Vol. 17: 78-85, 2016; and Hensley et al., Cephalalgia, Vol. 39: 827-840, 2019. The parasympathetic pathway is independent and parallel to the trigeminal sensory pathway that also controls the dura vasculature tone. Given the apparent differences in sites of action for the CGRP/CGRP receptor signaling and PACAP/PAC1 receptor signaling in migraine pathophysiology, it is believed that inhibiting both the CGRP receptor and the PAC1 receptor with the bispecific antigen binding proteins of the invention will provide greater efficacy in treating migraine headache than antagonizing either target alone. Thus, in some embodiments, the bispecific antigen binding proteins (e.g. heterodimeric antibodies) described herein have an additive or synergistic effect in treating migraine headache (e.g. reducing the frequency, duration, or severity of migraine headache) as compared to the treatment effect obtained with either an anti-CGRP receptor antibody or an anti-PAC1 receptor antibody alone.

In some embodiments, the patients to be treated according to the methods of the invention have, suffer from, or are diagnosed with episodic migraine. Episodic migraine is diagnosed when patients with a history of migraine (e.g. at least five lifetime attacks of migraine headache) have 14 or fewer migraine headache days per month. A "migraine headache day" includes any calendar day during which a patient experiences the onset, continuation, or recurrence of a "migraine headache" with or without aura lasting greater than 30 minutes. A "migraine headache" is a headache associated with nausea or vomiting or sensitivity to light or sound and/or a headache characterized by at least two of the following pain features: unilateral pain, throbbing pain, moderate to severe pain intensity, or pain exacerbated by physical activity. In certain embodiments, patients having, suffering from, or diagnosed with episodic migraine have at least four, but less than 15 migraine headache days per month on average. In related embodiments, patients having, suffering from, or diagnosed with episodic migraine have fewer than 15 headache days per month on average. As used herein, a "headache day" is any calendar day in which the patient experiences a migraine headache as defined herein or any headache that lasts greater than 30 minutes or requires acute headache treatment.

In certain embodiments, the patients to be treated according to the methods of the invention have, suffer from, or are diagnosed with chronic migraine. Chronic migraine is diagnosed when migraine patients (i.e. patients with at least five lifetime attacks of migraine headache) have 15 or more headache days per month and at least 8 of the headache days are migraine headache days. In some embodiments, patients having, suffering from, or diagnosed with chronic migraine have 15 or more migraine headache days per month on average. In certain embodiments of the methods described herein, administration of an anti-CGRP receptor antibody, antigen-binding fragment, or bispecific antigen binding protein of the invention prevents, reduces, or delays the progression of episodic migraine in the patient to chronic migraine.

In other embodiments, the present invention provides a method for treating or ameliorating cluster headache in a patient in need thereof comprising administering to the patient an effective amount of anti-CGRP receptor antibody, antigen-binding fragment, or bispecific antigen binding protein (e.g. heterodimeric antibody) described herein. Cluster headache is a condition that involves, as its most prominent feature, recurrent, severe headaches on one side of the head, typically around the eye (see Nesbitt et al., BMJ, Vol. 344:e2407, 2012). Cluster headaches often occur periodically: spontaneous remissions interrupt active periods of pain. Cluster headaches are often accompanied by cranial autonomic symptoms, such as tearing, nasal congestion, ptosis, pupil constriction, facial blushing, sweating, and swelling around the eye, often confined to the side of the head with the pain. The average age of onset of cluster headache is ~30-50 years. It is more prevalent in males with a male to female ratio of about 2.5:1 to about 3.5:1. Antibodies that inhibit binding of CGRP to the CGRP receptor have recently been shown to be effective in treating cluster headache. See Bardos et al., Neurology, Vol. 92 (15 Supplement), Plen02.004, 2019 and Giani et al., Neurol. Sci., Vol. 40 (Suppl 1): 129-135, 2019. In addition, a neurostimulation system, which delivers low-level (but high frequency, physiologic-blocking) electrical stimulation to the sphenopalatine ganglion, has demonstrated efficacy in relieving the acute debilitating pain of cluster headache in a recent clinical trial. See Schoenen J, et al., Cephalalgia, Vol. 33(10):816-30, 2013. In view of this clinical evidence, inhibition of CGRP/CGRP receptor signaling and/or PACAP/PAC1 receptor signaling with an anti-CGRP receptor antibody, antigen-binding fragment, or bispecific antigen binding protein (e.g. heterodimeric antibody) described herein is expected to have efficacy in treating cluster headache in humans.

Other conditions associated with CGRP receptor and/or PAC1 receptor signaling that may be treated according to the methods of the invention include, but are not limited to, chronic pain syndromes, such as arthritic pain (e.g. osteoarthritis and rheumatoid arthritis), visceral pain (e.g. pain associated with irritable bowel syndrome, Crohn's disease, ulcerative colitis, and interstitial cystitis), and neuropathic pain; neurogenic inflammation, tension-type headaches, hemiplegic migraine, retinal migraine, and vasomotor symptoms (e.g. hot flashes, facial flushing, sweating, and night sweats), such as those associated with menopause. In one embodiment, the condition to be treated by administering an anti-CGRP receptor antibody, antigen-binding fragment, or bispecific antigen binding protein (e.g. heterodimeric antibody) of the invention is chronic pain. In another embodiment, the condition to be treated by administering an anti-CGRP receptor antibody, antigen-binding fragment, or bispecific antigen binding protein (e.g. heterodimeric antibody) of the invention is neuropathic pain.

In any of the methods described herein, the treatment can comprise prophylactic treatment. Prophylactic treatment refers to treatment designed to be taken before the onset of a condition or an attack (e.g. before a migraine attack or onset of a cluster headache episode) to reduce the frequency, severity, and/or length of the symptoms (e.g. migraine or cluster headaches) in the patient.

In some embodiments, the methods of the invention for treating or preventing a headache condition in a patient comprise administering to the patient an anti-CGRP receptor antibody, antigen-binding fragment, or bispecific antigen binding protein (e.g. heterodimeric antibody) described herein in combination with one or more agents suitable for the acute or prophylactic treatment of migraine headache or other headache disorder described herein. The term "combination therapy" as used herein encompasses the administration of the two compounds (e.g. anti-CGRP receptor antibody/heterodimeric antibody and additional agent) in a sequential manner (i.e. each compound is administered at a different time in any order) as well as administration of the two compounds in a substantially simultaneous manner. Substantially simultaneous administration includes concurrent administration and can be accomplished by administering a single formulation comprising both compounds (e.g. a single formulation comprising a fixed ratio of both compounds or a pre-filled syringe having a fixed ratio of each compound) or concurrently administering separate formulations containing each of the compounds. Thus, in certain embodiments, the methods of the invention comprise administering an anti-CGRP receptor antibody, antigen-binding fragment, or bispecific antigen binding protein (e.g. heterodimeric antibody) described herein with a second headache therapeutic agent.

In certain embodiments, the second headache therapeutic agent may be an acute headache therapeutic agent used for the acute treatment of headaches or migraines. In some embodiments, the acute headache therapeutic agent is a serotonin (5-hydroxytryptamine; 5-HT) receptor agonist, for example a 5HT1 receptor agonist. The acute headache therapeutic agent can be an agonist of the $5HT_{1B}$, $5HT_{1D}$ and/or $5HT_{1F}$ serotonin receptors. Such serotonin receptor agonists include, but are not limited to, triptans (e.g., almotriptan, frovatriptan, rizatriptan, sumatriptan, naratriptan, eletriptan, and zolmitriptan), ergotamines (e.g., dihydroergotamine and ergotamine tartrate), and $5HT_{1F}$-selective serotonin receptor agonists, such as lasmiditan. Other suitable acute headache therapeutic agents include non-steroidal anti-inflammatory drugs (e.g., acetylsalicylic acid, ibuprofen, naproxen, indomethacin, and diclofenac), and opioids (e.g., codeine, morphine, hydrocodone, fentanyl, meperidine, and oxycodone). In one embodiment, the acute headache therapeutic agent administered in combination with an anti-CGRP receptor antibody, antigen-binding fragment, or bispecific antigen binding protein (e.g. heterodimeric antibody) of the invention is a triptan. In another embodiment, the acute headache therapeutic agent administered in combination with an anti-CGRP receptor antibody, antigen-binding fragment, or bispecific antigen binding protein (e.g. heterodimeric antibody) of the invention is an ergotamine. In yet another embodiment, the acute headache therapeutic agent administered in combination with an anti-CGRP receptor antibody, antigen-binding fragment, or bispecific antigen binding protein (e.g. heterodimeric antibody) of the invention is a non-steroidal anti-inflammatory drug. In still another embodiment, the acute headache therapeutic agent administered in combination with an anti-CGRP receptor antibody, antigen-binding fragment, or bispecific antigen binding protein (e.g. heterodimeric antibody) of the invention is an opioid.

In some embodiments, the second headache therapeutic agent is a prophylactic headache therapeutic agent used for the prophylactic treatment of headaches or migraines. In one embodiment, the prophylactic headache therapeutic agent is an antiepileptic, such as divalproex, sodium valproate, valproic acid, topiramate, or gabapentin. In another embodiment, the prophylactic headache therapeutic agent is a beta-blocker, such as propranolol, timolol, atenolol, metoprolol, or nadolol. In yet another embodiment, the prophylactic headache therapeutic agent is an anti-depressant, such as a tricyclic antidepressant (e.g. amitriptyline, nortriptyline, doxepin, and fluoxetine). In still another embodiment, the prophylactic headache therapeutic agent is onabotulinum toxin A.

In certain embodiments, the methods of the invention comprise administering an anti-CGRP receptor antibody or antigen-binding fragment thereof described herein with an antagonist of the PACAP/PAC1 receptor signaling pathway. For example, the anti-CGRP receptor antibody or antigen-binding fragment of the invention can be administered in combination with a PACAP/PAC1 receptor pathway antagonist to treat or prevent a headache condition (e.g. migraine or cluster headache) in a patient in need thereof. In some embodiments, the PACAP/PAC1 receptor pathway antagonist is an antagonist of the human PAC1 receptor. PAC1 receptor antagonists can be peptide antagonists of the receptor, such as those described in WO 2018/222991, which is hereby incorporated by reference in its entirety. In certain embodiments, the PAC1 receptor antagonist to be administered with the anti-CGRP receptor antibodies and antigen-binding fragments of the invention is a monoclonal antibody that specifically binds to the human PAC1 receptor, such as any of the anti-PAC1 receptor antibodies described herein or the antibodies described in WO 2014/144632, which is hereby incorporated by reference in its entirety. In some embodiments, the PACAP/PAC1 receptor pathway antagonist to be administered with the anti-CGRP receptor antibody or antigen-binding fragment of the invention to treat or prevent a headache condition (e.g. migraine or cluster headache) in a patient is an antagonist of the PACAP ligand. A PACAP ligand antagonist can be a decoy or soluble PAC1, VPAC1, or VPAC2 receptor or other protein that binds to the PACAP ligand, such as an anti-PACAP ligand antibody. Anti-PACAP ligand antibodies are known in the art and are described, for example, in WO2016/168762; WO2016/168768; WO2017/106578; WO/2017/181031; and WO/2017/181039, all of which are hereby incorporated by reference in their entireties. In certain embodiments, the PACAP ligand antagonist to be administered with the anti-CGRP receptor antibodies and antigen-binding fragments of the invention is a monoclonal antibody that specifically binds to human PACAP38 and/or human PACAP27.

The anti-CGRP receptor antibodies, antigen-binding fragments, and bispecific antigen binding proteins of the invention are useful for detecting CGRP receptor and/or PAC1 receptor in biological samples and identification of cells or tissues that express the CGRP receptor and/or PAC1 receptor. For instance, the anti-CGRP receptor antibodies, antigen-binding fragments, and bispecific antigen binding proteins can be used in diagnostic assays, e.g., immunoassays to detect and/or quantify CGRP receptor and/or PAC1 receptor expressed in a tissue or cell. In addition, the anti-CGRP receptor antibodies, antigen-binding fragments, and bispecific antigen binding proteins described herein can be used to inhibit CGRP receptor from forming a complex with its ligand CGRP, thereby modulating the biological activity of CGRP receptor in a cell or tissue. Likewise, the bispecific antigen binding proteins described herein can be used to inhibit PAC1 receptor from forming a complex with its ligand PACAP, thereby modulating the biological activity of PAC1 receptor in a cell or tissue. Examples of biological activities of the CGRP and PAC1 receptors that can be modulated include, but are not limited to, elevation of intracellular cAMP, vasodilation and/or neurogenic inflammation.

The anti-CGRP receptor antibodies, antigen-binding fragments, and bispecific antigen binding proteins described herein can be used for diagnostic purposes to detect, diagnose, or monitor diseases and/or conditions associated with the CGRP receptor and/or the PAC1 receptor, including migraine, cluster headache, and chronic pain. Also provided are methods for the detection of the presence of CGRP receptor or PAC1 receptor in a sample using classical immunohistological methods known to those of skill in the art (e.g., Tijssen, 1993, Practice and Theory of Enzyme Immunoassays, Vol 15 (Eds R. H. Burdon and P. H. van Knippenberg, Elsevier, Amsterdam); Zola, 1987, Monoclonal Antibodies: A Manual of Techniques, pp. 147-158 (CRC Press, Inc.); Jalkanen et al., 1985, J. Cell. Biol. 101:976-985; Jalkanen et al., 1987, J. Cell Biol. 105:3087-3096). Examples of methods useful in the detection of the presence of CGRP receptor and/or PAC1 receptor include immunoassays, such as the enzyme linked immunosorbent assay (ELISA) and the radioimmunoassay (MA), using the anti-CGRP receptor antibodies, antigen-binding fragments, and bispecific antigen binding proteins described herein. The detection of either receptor (CGRP receptor or PAC1 receptor) can be performed in vivo or in vitro.

For diagnostic applications, the antibody or antigen binding protein can be labeled with a detectable labeling group. Suitable labeling groups include, but are not limited to, the following: radioisotopes or radionuclides (e.g., $^{3}H$, $^{14}C$, $^{15}N$, $^{35}S$, $^{90}Y$, $^{99}Tc$, $^{111}In$, $^{125}I$, $^{131}I$), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antibody or antigen binding protein via spacer arms of various lengths to reduce potential steric hindrance. Various methods for labeling proteins are known in the art and may be used.

In another embodiment, the anti-CGRP receptor antibody, antigen-binding fragment, or bispecific antigen binding protein described herein can be used to identify a cell or cells that express CGRP receptor and/or PAC1 receptor. In a specific embodiment, the antibody, antigen-binding fragment, or antigen binding protein is labeled with a labeling group and the binding of the labeled antibody, antigen-binding fragment, or antigen binding protein to CGRP receptor and/or PAC1 receptor is detected. The antibodies, antigen-binding fragments, or antigen binding proteins can also be used in immunoprecipitation assays in biological samples. In a further specific embodiment, the binding of the antibody, antigen-binding fragment, or antigen binding protein to CGRP receptor and/or PAC1 receptor is detected in vivo. In a further specific embodiment, the anti-CGRP receptor antibody, antigen-binding fragment, or bispecific antigen binding protein is isolated and measured using techniques known in the art. See, for example, Harlow and Lane, 1988, Antibodies: A Laboratory Manual, New York: Cold Spring Harbor (ed. 1991 and periodic supplements); John E. Coligan, ed., 1993, Current Protocols In Immunology New York: John Wiley & Sons.

The following examples, including the experiments conducted and the results achieved, are provided for illustrative purposes only and are not to be construed as limiting the scope of the appended claims.

EXAMPLES

Example 1. Design and Generation of Improved Affinity Anti-CGRP Receptor Antibodies Anti-CGRP receptor antibody variants with enhanced binding and inhibitory function were identified through affinity maturation of the 4E4.2 antibody (VH region of SEQ ID NO: 48; VL region of SEQ ID NO: 24) by fluorescence-assisted cell sorting (FACS) of yeast-displayed Fab libraries. To focus the mutational efforts on a limited subset of CDR residues, the structure of the highly related 4E4 Fab (VH region of SEQ ID NO: 47; VL region of SEQ ID NO: 23), which has CDRs that are nearly identical to those of the 4E4.2 antibody, was analyzed to identify up to five surface-exposed residues within each CDR loop for MIX19 saturation mutagenesis. MIX19 represents a trimer phosphoramidite (codon) mixture encoding all amino acids except for cysteine. Because the antigen is expected to make direct contacts with the surface-exposed residues, it was hypothesized that changing the nature of these contacts or creating new contacts through comprehensive mutagenesis could lead to improved binding. In addition, restricted diversity (conservative mutations, <4 possible mutations) was also included at select partially buried CDR residues that may subtly alter the conformation of the CDR loops.

To restrict theoretical diversities of each library to a manageable $10^6$-$10^7$, one separate library per CDR was constructed. The CDRH3 of the 4E4 Fab is unusually long (21 residues) and contains 10 surface-exposed residues. The surface-exposed tyrosine residues within this CDR were not mutated, as tyrosine residues are often critical mediators of protein-protein interactions. As a result, the remaining five surface-exposed CDRH3 residues were chosen for MIX19 saturation mutagenesis. In total, six individual-CDR Fab libraries were designed and constructed, targeting 19 heavy chain and 16 light chain CDR residues for diversification. A summary of the diversification strategy is set forth in Table 11 below.

TABLE 11

Diversification Strategy for Yeast-Displayed CDR-Fab Libraries

| Heavy Chain | | Light Chain | |
|---|---|---|---|
| Heavy Chain Amino Acid Position (relative to SEQ ID NO: 48) | Chosen Diversity[1] | Light Chain Amino Acid Position (relative to SEQ ID NO: 24) | Chosen Diversity[1] |
| Thr28 | MIX19 | Ser26 | MIX19 |
| Ser30 | MIX19 | Asn31 | MIX19 |
| Ser31 | MIX19 | Asn32 | MIX19 |
| Phe32 | Phe, Tyr | Tyr33 | MIX19 |
| Gly33 | Gly, Ala | Asp51 | Asp, Glu |
| Met34 | Met, Phe, Ile, Leu | Asn53 | MIX19 |
| His35 | His, Asn, Ser, Arg | Lys54 | MIX19 |
| Phe53 | Phe, Tyr | Arg55 | Arg, Leu |
| Asp54 | MIX19 | Pro56 | Pro, Ala, Glu, Gln |
| Ser56 | MIX19 | Ser57 | MIX19 |
| Ile57 | MIX19 | Ser94 | MIX19 |
| Lys58 | MIX19 | Arg95 | MIX19 |
| Tyr59 | MIX19 | Leu96 | MIX19 |
| Ser60 | Ser, Tyr | Ser97 | MIX19 |
| Asn102 | MIX19 | Ala98 | Ala, Ser, Val, Phe |
| Glu105 | MIX19 | Val100 | Val, Thr, Ala, Ile |
| Ser107 | MIX19 | | |
| His111 | MIX19 | | |
| Lys113 | MIX19 | | |

[1]Chosen Diversity refers to the amino acids substituted at the indicated position; MIX19 denotes that all amino acids except cysteine were substituted at the indicated position.

The six yeast-displayed Fab libraries were enriched for binding to the CGRP receptor extracellular domain (ECD) and/or detergent-solubilized lysates of CGRP receptor-expressing cells using FACS (FIG. 1). To capitalize on the exquisite control of selection pressure afforded by FACS, yeast cells displaying the parental 4E4.2 Fab were subjected to the same binding and fluorescent staining conditions to precisely define sort gates that would enrich specifically for improved binders from the yeast pools. For further affinity improvements, two CDR-shuffled Fab libraries that combined enriched mutations from the individual CDR libraries and a final chain-shuffled library that combined enriched mutations from each CDR-shuffled library were also constructed. These libraries were subjected to selections for CGRP receptor binding under more stringent conditions.

Over 1000 individual yeast Fab clones isolated from the binding-enriched pools were screened for improved binding to human CGRP receptor ECD compared to the parental 4E4.2 Fab (Table 12). Improved binding to cynomolgus monkey CGRP receptor for the clones was also confirmed (Table 13). The clones were tested for non-specific binding to blank (non-expressing) CHO and HEK cell lines, as well as to the ECDs of unrelated receptors (programmed cell death protein 1 (PD1) and PAC1). Mutants whose sequences introduced additional potential aspartate isomerization, asparagine deamidation, and tryptophan oxidation sites relative to the starting 4E4.2 sequence were also removed during the screen. In summary, the binding screens yielded 35 mutants with improved binding to human and cynomolgus monkey CGRP receptor with minimal binding to PAC1 ECD, CHO cells, and HEK cells. However, the mutants exhibited varying degrees of non-specific binding to unrelated PD1 ECD protein. The 35 affinity-matured variants were stratified into three tiers based on their extent of non-specific binding to PD1, with Tier 1 mutants showing no binding and Tier 3 mutants showing the most binding. The more specific binding mutants tended to come from the individual CDR libraries. CDR-shuffled and chain-shuffled libraries yielded variants with higher human and cynomolgus monkey CGRP receptor binding signals, but usually at the cost of some non-specific binding to PD1. The yeast binding screen data for the Tier 1 mutants are shown in Tables 12 and 13 below. For experiments using soluble antigen (i.e. ECDs of human CGRP receptor or human PAC1 receptor), a normalized binding/display ratio for each clone was calculated by dividing the median fluorescence binding signal for each clone by the median fluorescence display signal for each clone (Table 12). For experiments employing detergent-solubilized lysates of CGRP receptor-expressing cells, a receptor-specific binding ratio for each clone was calculated by dividing the median fluorescence binding signal for each clone against the detergent-solubilized lysate from cells expressing the CGRP receptor by the median fluorescence binding signal for each clone against the detergent-solubilized lysate from blank cells (i.e. non-CGRP receptor expressing cells)(Table 13). The light and heavy chain variable region sequences for each of the Tier 1 mutants are provided in Tables 2A and 2B, respectively.

TABLE 12

Tier 1 Improved Binders to Human CGRP Receptor ECD from Yeast-Displayed Fab Library Screen

| | 10 nM human CGRP receptor ECD | | 1 nM human CGRP receptor ECD | | 10 nM PAC1 receptor ECD | |
|---|---|---|---|---|---|---|
| Variant Ab ID. | Normalized Binding Signal/ Display Signal (B/D) | Mutant vs. 4E4.2 Parent B/D Ratio | Normalized Binding Signal/ Display Signal (B/D) | Mutant vs. 4E4.2 Parent B/D Ratio | Normalized Binding Signal/ Display Signal (B/D) | Mutant vs. 4E4.2 Parent B/D Ratio |
| 10 | 2.04 | 13.3 | 0.40 | 3.3 | 0.10 | 0.9 |
| 05 | 3.78 | 24.6 | 0.82 | 6.7 | 0.20 | 1.8 |
| 11 | 3.38 | 22.0 | 1.36 | 11.0 | 0.16 | 1.5 |
| 12 | 1.50 | 9.7 | 0.35 | 2.8 | 0.19 | 1.8 |
| 13 | 1.51 | 9.8 | 0.35 | 2.9 | 0.11 | 1.0 |
| 06 | 1.13 | 7.4 | 0.27 | 2.2 | 0.10 | 1.0 |
| 01 | 0.89 | 5.8 | 0.21 | 1.7 | 0.09 | 0.8 |
| 09 | 1.62 | 10.6 | 0.38 | 3.0 | 0.17 | 1.6 |
| 07 | 0.81 | 5.3 | 0.22 | 1.8 | 0.13 | 1.2 |
| 02 | 0.58 | 3.8 | 0.17 | 1.4 | 0.10 | 0.9 |
| 14 | 0.33 | 2.2 | 0.12 | 1.0 | 0.08 | 0.7 |
| 08 | 0.48 | 3.1 | 0.17 | 1.4 | 0.10 | 1.0 |
| 04 | 0.53 | 3.4 | 0.20 | 1.6 | 0.12 | 1.1 |
| 15 | 0.42 | 2.7 | 0.16 | 1.3 | 0.10 | 0.9 |
| 4E4.2 parent | 0.15 | 1.0 | 0.12 | 1.0 | 0.11 | 1.0 |

TABLE 13

Tier 1 Improved Binders to Lysates from Human and Cynomolgus Monkey CGRP Receptor-Expressing Cells from Yeast-Displayed Fab Library Screen

| | Human CGRP Receptor/AMID Detergent-Solubilized Cell Lysate | | Cynomolgus Monkey CGRP Receptor/HEK Detergent-Solubilized Cell Lysate | |
|---|---|---|---|---|
| Variant Ab ID. | Human CGRP Receptor/Blank Cells Specific Binding | Mutant vs. 4E4.2 Parent Specific Binding Ratio | Cyno CGRP Receptor/Blank Cells Specific Binding | Mutant vs. 4E4.2 Parent Specific Binding Ratio |
| 10 | 20.7 | 2.6 | 3.0 | 1.6 |
| 05 | 24.4 | 3.1 | 5.2 | 2.7 |
| 11 | 9.5 | 1.2 | 5.3 | 2.8 |
| 12 | 19.5 | 2.4 | 10.3 | 5.4 |
| 13 | 14.6 | 1.8 | 4.8 | 2.5 |
| 06 | 17.5 | 2.2 | 4.8 | 2.5 |
| 01 | 25.8 | 3.2 | 4.6 | 2.4 |
| 09 | 10.4 | 1.3 | 2.3 | 1.2 |
| 07 | 11.7 | 1.5 | 3.1 | 1.6 |
| 02 | 14.2 | 1.8 | 5.3 | 2.8 |
| 14 | 13.5 | 1.7 | 2.2 | 1.1 |
| 08 | 18.0 | 2.3 | 4.9 | 2.5 |
| 04 | 9.5 | 1.2 | 3.1 | 1.6 |
| 15 | 11.9 | 1.5 | 4.2 | 2.2 |
| 4E4.2 parent | 8.0 | 1.0 | 1.9 | 1.0 |

To evaluate the effect of the mutations in the heavy and light chain variable regions identified in the yeast display libraries on the inhibitory potency of the anti-CGRP receptor antibody, a subset of the variants was produced by recombinant expression methods as complete bivalent monoclonal antibodies and evaluated in a cell-based cAMP assay as described in more detail below. The light chains of the monoclonal antibodies comprised the light chain variable region from the indicated antibody variant fused to a human lambda light chain constant region having the sequence of SEQ ID NO: 56. The heavy chains of the monoclonal antibodies comprised the heavy chain variable region from the indicated antibody variant fused to an aglycosylated, disulfide-stabilized human IgG1z constant region having the sequence of SEQ ID NO: 66. The aglycosylated, disulfide-stabilized human IgG1z constant region comprised the sequence of a human IgG1z Fc region with N297G, R292C, and V302C mutations according to EU numbering. The sequences for the full light and heavy chains for the bivalent monoclonal antibodies are provided in Tables 5A and 5B, respectively.

CGRP receptor antibody variant sequences were generated by site directed mutagenesis (SDM) or by Golden Gate Assembly (GGA) in those cases where SDM was unsuccessful. Site directed mutagenesis utilized paired mutagenic primers that flanked the mutation site. Whole vector PCR reactions were carried out using double stranded plasmid DNA templates. The primers for all of the desired mutations in a particular clone were combined into a master primer mix, with one to several mutations being incorporated in an individual reaction. Following amplification, the template plasmid DNA was removed by digestion with DpnI, an endonuclease which preferentially cleaves methylated DNA. The SDM product was then transformed into competent cells for growth and screening by sequencing. The SDM reactions were performed using the QuikChange Lightning Multi Site-Directed Mutagenesis Kit (Agilent) following the manufacturer's directions.

Where SDM was unsuccessful, an alternative cloning strategy was utilized. Briefly, GGA relied upon Type II restriction enzymes and T4 DNA ligase to cut and seamlessly ligate together multiple DNA fragments. (Engler et al., PLOS One, Vol. 3(11): e3647, 2008). In this example, the multiple DNA fragments consisted of (i) a synthetic nucleic acid sequence (gBlock, Integrated DNA Technologies, Coralville, IA) encoding a Kozak consensus sequence, a signal peptide sequence and an antibody variable region sequence; (ii) an antibody constant domain fragment released from a Parts vector; and (iii) the expression vector backbone. The GGA reactions were composed of 10 ng of gBlock, 10 ng of the Part vector, 10 ng of the expression vector, 1 μl 10× Fast Digest Reaction Buffer+0.5 mM ATP (Thermo Fisher, Waltham, MA), 0.5 μl FastDigest Esp3I (Thermo Fisher, Waltham, MA), 1 μl T4 DNA Ligase (5U/μl, Thermo Fisher, Waltham, MA) and water to 10 μl. The reactions were performed over 15 cycles consisting of a 2 minute digestion step at 37° C. and a 3 minute ligation step at 16° C. The 15 cycles were followed by a final 5 minute 37° C. digestion step and a 5 minute enzyme inactivation step at 80° C.

Following cloning, CGRP receptor antibody polypeptides were generated by transiently transfecting 293 HEK cells with the corresponding cDNAs. The cDNAs also encoded a signal peptide sequence of either MDMRVPAQLLGLLLLWLRGARC (SEQ ID NO: 455) or MAWALLLLTLLTQGTGSWA (SEQ ID NO: 456). Cells at $1.5\times10^6$ cells/ml were transfected with 0.5 mg/L DNA (0.5 mg/L CGRPR in the pTT5 vector) or (0.1 mg/L CGRPR in pTT5 vector with 0.4 mg/L empty pTT5 vector) (Durocher et al., NRCC, Nucleic Acids. Res., Vol. 30: e9, 2002) with 4 ml PEI/mg DNA in F17 media (Thermo Fisher). Yeastolate and Glucose were added to cultures 1 hour after transfection, and cells were then grown in suspension using F17 expression medium supplemented with 0.1% Kolliphor, 6 mM L-Glutamine and 50 μg/ml Geneticin for 6 days after which the conditioned media was harvested for purification.

The CGRP receptor antibody variants were purified from the conditioned media using protein A affinity chromatography (Mab Select SuRe, GE Healthcare Life Sciences, Little Chalfont, Buckinghamshire, UK) followed by cation exchange chromatography (SP Sepharose High Performance columns (SP HP) (GE Healthcare Life Sciences). The protein concentration of each purified pool was determined by UV absorbance at 280 nm (A280) using a NanoDrop 2000 (Thermo Fisher Scientific, Rockford, Illinois, USA). The purified pools were dialyzed against 2 L of 10 mM sodium-acetate, 9% sucrose, pH 5.2 (A52Su) using 20 kDa MWCO Slide-A-Lyzer dialysis flasks (Thermo Fisher Scientific) for 2 hours at 4° C. with gentle stirring on a stir plate. The used dialysate was decanted away, a fresh 2 L of A52Su was added and dialysis proceeded overnight. After dialysis, the samples were concentrated using 30 kDa MWCO ultrafiltration concentrators (Thermo Fisher Scientific) centrifuged at 2,000×g in a swinging-bucket rotor until each sample was approximately 40 mg/mL based on A280. The final products were analyzed for main peak purity using Caliper LabChip GXII microcapillary electrophoresis (PerkinElmer, Waltham, Massachusetts, USA) and size exclusion chromatography using an ACQUITY UPLC Protein BEH SEC column, 200A, 4.6×300 mm (Waters Corporation, Milford, Massachusetts, USA). The endotoxin content was measured using an Endosafe-MCS (Charles River, Wilmington, Massachusetts, USA) and 0.05 EU/mL PTS cartridges (Charles River).

The functional activity of the purified monoclonal antibodies was assessed using a cell-based CGRP receptor cAMP activity assay. CGRP is an agonist of the CGRP receptor, activation of which results in an increase in intracellular cAMP. The assay employed a human neuroblastoma-derived cell line (SK-N-MC; Spengler, et al., (1973) In Vitro 8: 410) obtained from ATCC (ATCC Number HTB-10; "HTB-10 cells"). HTB-10 cells express human CRLR and human RAMP1, which form the human CGRP receptor (McLatchie et al., (1998) Nature, 393:333-339). The LANCE Ultra cAMP assay kit (PerkinElmer, Boston, MA) was used to measure cAMP concentration. The assays were performed in white 96-well plates in a total volume of 60 μL. Briefly, on the day of the assay, the frozen HTB-10 cells were thawed at 37° C. and were washed once with assay buffer. 10 μL of cell suspension containing 2000 cells was added into 96 half-area white plates. After adding 10 μL of the anti-CGRP receptor variant monoclonal antibody (10 point dose response curve: final concentration ranges from 1 μM to 0.5 fM), the mixture was incubated for 30 min at room temperature. Then, 10 μL of human α-CGRP (3 nM final concentration) was added and further incubated for 15 min at room temperature. After human α-CGRP stimulation, 30 μL of detection mix was added and incubated for 60 minutes at room temperature. The plates were read on EnVision instrument (PerkinElmer, Boston, MA) at emission wavelengths of 665 nm and 615 nm. Data were processed and analyzed by Prizm (GraphPad Software Inc.) to show POC (percent of control, in which control is defined as the activity of the agonist used in the assay) as a function of the tested antagonist concentration (e.g. anti-CGRP receptor variant antibody), and were fitted with standard nonlinear regression curves to yield IC50 values. POC was calculated as follows:

$$POC = 100 \times \frac{Em665}{Em615} \text{ of } \frac{\text{Agonist response with antagonist} - \text{cell response without agonist and antagonist}}{\text{Agonist response without anatagonist} - \text{cell response without agonist and antagonist}}$$

The results of the functional assay for a subset of the variants in comparison to the 4E4 control monoclonal antibody (VH region of SEQ ID NO: 47; VL region of SEQ ID NO: 23) are shown in Table 14 below.

TABLE 14

In vitro inhibitory potency of CGRP receptor variant antibodies

| Ab Id. | Run 1 IC50 (nM) | Run 2 IC50 (nM) | Average IC50 (nM) | Fold-improvement over 4E4 Ab |
|---|---|---|---|---|
| 10 | 0.43 | 0.68 | 0.56 | 1.0 |
| 05 | 0.15 | 0.25 | 0.20 | 2.7 |
| 06 | 0.14 | 0.15 | 0.15 | 3.7 |
| 01 | 0.13 | 0.14 | 0.14 | 3.9 |
| 09 | 0.73 | 1.00 | 0.86 | 0.6 |
| 07 | 0.18 | 0.39 | 0.29 | 1.9 |
| 02 | 0.10 | 0.13 | 0.12 | 4.6 |
| 08 | 0.28 | 0.31 | 0.30 | 1.8 |
| 04 | 0.14 | 0.21 | 0.17 | 3.1 |
| 4E4.2 | 0.34 | 0.56 | 0.45 | 1.2 |

When the sequences of the most specific Fab binders (e.g. antibody Ids. 05, 06, 01, 02, and 04) were converted and produced as bivalent monoclonal antibodies, approximately a 3- to 4-fold improved CGRP receptor blocking activity compared to the 4E4 antibody control was observed. Most of the variants were also more potent than the 4E4.2 parental antibody (light chain of SEQ ID NO: 70 and heavy chain of SEQ ID NO: 86).

In summary, guided by the structure of the 4E4 Fab alone, six combinatorial libraries of 4E4 mutants representing each individual CDR were designed, constructed, and sorted for improved binding to the CGRP receptor ECD and detergent-solubilized lysates of CGRP receptor-expressing cells. For further affinity improvements, two CDR-shuffled Fab libraries that combined enriched mutations from the individual CDR libraries and a final chain-shuffled library that combined enriched mutations from each CDR-shuffled library were also constructed. Binding screens of individual yeast Fab clones isolated from enriched pools yielded improved binders to human and cynomolgus monkey CGRP receptor with varying degrees of non-specific binding to ECDs of unrelated PD1 and PAC1. The Fab molecules that exhibited the highest specific binding to human CGRP receptor were converted to bivalent monoclonal antibodies and evaluated for functional activity in a cell-based cAMP assay. Several of these top binders had a 3- to 4-fold increase in potency in inhibiting ligand-induced activation of the receptor compared to the 4E4 and 4E4.2 parental antibodies.

Example 2. Generation of Anti-CGRP Receptor/Anti-PAC1 Receptor Hetero-Immunoglobulins To generate a hetero-immunoglobulin with specific binding capability to both the human CGRP receptor and the human PAC1 receptor, each of three of the improved affinity anti-CGRP receptor antibodies from Example 1 (antibodies 01, 02, and 03 described herein) were co-expressed with each of 32 different anti-PAC1 receptor antibodies (antibodies 101 to 132 described herein). Generating bispecific antibodies through this co-expression approach can lead to the production of molecules other than the desired bispecific, heterotetramer molecule, which comprises a heavy and light chain from the first antibody (e.g. anti-CGRP receptor antibody) and a heavy and light chain from the second antibody (e.g. anti-PAC1 receptor antibody). One set of contaminants results from homodimerization of the heavy chains through the Fc regions to generate conventional monospecific antibodies rather than the desired heterodimerization of the two different heavy chains. The second type of contaminants results from mispairing of the light chains to the heavy chains. Light chains can be promiscuous and pair with either of the two different heavy chains, which can lead to a mispaired light-heavy chain Fab assembly that may not retain the activity and binding to the desired target.

To prevent these types of contaminants, the antibodies were further engineered using a charge pair mutation strategy (see, e.g., WO2009089004 and WO2014081955, both of which are hereby incorporated by reference in their entireties). Specifically, charged residues are introduced or exploited to drive heavy chain heterodimerization and light-heavy chain association. The charge pair mutations (CPMs) in the CH3 domain of the Fc region drive the heterodimerization of the two different heavy chains through opposite charges that cause electrostatic attraction (see, e.g., WO2009089004 and U.S. Pat. No. 8,592,562); the two identical heavy chain combinations have identical charges and are therefore repelled. The correct heavy chain-light chain pairing is facilitated by CPMs at the CH1/CL binding interface or between the VH/VL and CH1/CL binding interfaces. The correct heavy chain-light chain combinations will have opposite charges and therefore be attracted to each other, whereas the incorrect heavy chain-light chain combinations will have the same charges and be repelled. As a result, the correctly assembled hetero-immunoglobulin will have at least two CPMs that drive the assembly of the preferred heterotetramer comprising two different heavy chains and two different light chains so that the heterotetramer will be the primary molecule generated by the expression system.

Various combinations of three anti-CGRP receptor antibodies (antibodies 01, 02, and 03 described herein) and 32 anti-PAC1 receptor antibodies (antibodies 101 to 132 described herein) were utilized to generate 199 distinct bispecific hetero-immunoglobulin molecules using high throughput cloning, expression, and purification. Each of the bispecific hetero-immunoglobulin molecules had one of the four CPM formats shown in FIG. 2. In addition, the bispecific hetero-immunoglobulin molecules were further engineered to remove glycosylation sites, improve stability, and enhance FcRn receptor binding. Specifically, the heavy chains included an N297G mutation to eliminate the glycosylation in the CH2 domain and an engineered disulfide bond introduced through R292C and V302C mutations in the CH2 domain to improve stability in the absence of glycosylation. A few of the bispecific hetero-immunoglobulin molecules had M252Y, S254T, and T256E mutations in the CH2 domain to enhance circulation half-life by increasing the affinity of the molecules for the FcRn receptor. All amino acid positions for the indicated mutations are according to the EU numbering scheme. The identity of the components for each of the 199 bispecific hetero-immunoglobulin molecules is set forth in Table 8 and the corresponding sequences for the components can be found in Tables 2A, 2B, 5A, 5B, 6A, 6B, 7A, and 7B.

The bispecific hetero-immunoglobulin molecules were tested for their ability to inhibit ligand-induced activation of the human CGRP receptor and the human PAC1 receptor using cell-based cAMP assays. The assay employed to evaluate the bispecific hetero-immunoglobulin molecules for inhibitory activity against the human CGRP receptor was the same as the assay described in Example 1. The assay to assess inhibitory activity against the human PAC1 receptor was also a cell-based cAMP activity assay. For the PAC1 receptor activity assay, a human neuroblastoma-derived cell line (SH-SY5Y; Biedler J L et al., Cancer Res., Vol. 38: 3751-3757, 1978) obtained from ATCC (ATCC Number CRL-2266; "CRL-2266 cells") was used. CRL-2266 cells express human PAC1 receptor endogenously (Monaghan et al., J Neurochem., Vol. 104(1): 74-88, 2008). The LANCE Ultra cAMP assay kit (PerkinElmer, Boston, MA) was used to measure cAMP concentration. On the day of the assay, the frozen CRL-2266 cells were thawed at 37° C. and were washed once with assay buffer. 10 μL of cell suspension containing 2,000 cells was added into 96 half-area white plates. After adding 10 μL of the bispecific hetero-immunoglobulin (10 point dose response curve: concentration range from 1 μM to 0.5 fM), the mixture was incubated for 30 min at room temperature. Then, 10 μL of human PACAP38 (10 pM final concentration) was added as an agonist and the mixture was further incubated for 15 min at room temperature. After human PACAP38 stimulation, 30 μL of detection mix was added and incubated for 60 minutes at room temperature. The plates were read on EnVision instrument (PerkinElmer, Boston, MA) at emission wavelengths 665 nm and 615 nm. Data were processed and analyzed by Prizm (GraphPad Software Inc.) to show POC (percent of control, in which control is defined as the activity of the agonist used in the assay) as a function of the tested antagonist concentration (e.g. bispecific hetero-immunoglobulin), and were fitted with standard nonlinear regression curves to yield IC50 values. POC was calculated as follows:

$$POC = 100 \times \frac{Em665}{Em615} \text{ of } \frac{\text{Agonist response with antagonist} - \text{cell response without agonist and antagonist}}{\text{Agonist response without anatagonist} - \text{cell response without agonist and antagonist}}$$

The results of the functional assays for a subset of the bispecific hetero-immunoglobulins described in Table 8 for inhibitory activity of both the human CGRP and PAC1 receptors are shown in Table 15 below. The fold-increase in IC50 as compared to the 4E4 control monoclonal antibody (light chain of SEQ ID NO: 69 and heavy chain of SEQ ID NO: 85) in the CGRP receptor assay and the fold-increase in IC50 as compared to the 29G4v22 control monoclonal antibody (light chain of SEQ ID NO: 231 and heavy chain of SEQ ID NO: 242) in the PAC1 receptor assay are also provided.

TABLE 15

In vitro inhibitory potency of bispecific hetero-immunoglobulins

| | Human CGRP Receptor | | | Human PAC1 Receptor | | |
|---|---|---|---|---|---|---|
| Molecule Designation | IC50 (nM) | SD | Fold-improvement over 4E4 Ab | IC50 (nM) | SD | Fold-improvement over 29G4v22 Ab |
| iPS:454557 (5601) | 0.39 | | 1.5 | 0.61 | | 6.7 |
| iPS:454565 (5606) | 0.66 | 0.14 | 0.8 | 0.69 | 0.12 | 5.9 |
| iPS:454569 | 1.42 | | 0.41 | 1.27 | | 3.8 |
| iPS:454583 | 0.51 | 0.08 | 1.1 | 2.48 | 0.21 | 2.8 |
| iPS:454585 | 0.51 | 0.06 | 1.1 | 2.65 | 0.59 | 2.1 |
| iPS:454587 | 0.58 | 0.21 | 0.9 | 4.36 | 0.95 | 1.3 |
| iPS:454729 | 0.53 | 0.13 | 1.0 | 0.97 | 0.04 | 6.9 |
| iPS:454731 | 0.52 | 0.16 | 1.0 | 3.76 | 0.12 | 1.8 |
| iPS:454733 | 0.55 | 0.09 | 0.9 | 2.21 | 0.26 | 3.0 |
| iPS:454735 | 0.52 | 0.18 | 1.0 | 1.95 | 0.59 | 3.4 |
| iPS:454737 | 0.55 | 0.11 | 0.9 | 2.38 | 0.21 | 2.8 |
| iPS:454739 | 0.57 | 0.15 | 0.9 | 1.92 | 0.10 | 3.5 |
| iPS:454741 | 0.64 | 0.03 | 0.8 | 1.58 | 0.47 | 4.2 |
| iPS:454743 | 0.52 | 0.14 | 1.1 | 1.66 | 0.23 | 3.8 |
| iPS:454745 | 0.46 | 0.16 | 1.3 | 1.20 | 0.22 | 5.2 |
| iPS:454747 | 0.49 | 0.11 | 1.2 | 3.09 | 0.76 | 2.0 |
| iPS:454749 | 0.41 | 0.13 | 1.4 | 0.83 | 0.08 | 7.5 |
| iPS:454751 | 0.43 | 0.22 | 1.2 | 0.52 | 0.04 | 12.2 |
| iPS:454753 | 0.37 | 0.17 | 1.3 | 0.61 | 0.13 | 10.4 |
| iPS:454755 | 0.27 | 0.14 | 1.8 | 0.69 | 0.16 | 9.2 |
| iPS:454757 | 0.43 | 0.19 | 1.4 | 0.68 | 0.06 | 9.2 |
| iPS:454759 | 0.39 | 0.10 | 1.5 | 0.74 | 0.15 | 8.5 |
| iPS:454761 | 0.42 | 0.15 | 1.4 | 0.97 | 0.20 | 6.4 |
| iPS:454763 | 0.32 | 0.10 | 1.5 | 0.75 | 0.01 | 8.5 |
| iPS:454765 | 0.34 | 0.18 | 1.6 | 0.71 | 0.04 | 7.8 |
| iPS:454767 | 0.41 | 0.08 | 1.2 | 0.71 | 0.24 | 9.0 |
| iPS:454769 | 0.32 | 0.08 | 1.7 | 0.78 | 0.04 | 7.2 |
| iPS:454771 | 0.37 | 0.03 | 1.4 | 0.84 | 0.13 | 7.6 |
| iPS:454773 | 0.57 | 0.13 | 0.9 | 0.83 | 0.21 | 7.7 |
| iPS:454775 | 0.38 | 0.04 | 1.4 | 0.83 | 0.10 | 6.7 |
| iPS:454783 | 0.48 | 0.01 | 1.1 | 0.62 | 0.04 | 9.1 |
| iPS:454785 | 0.47 | 0.13 | 1.1 | 1.43 | 0.53 | 4.6 |
| iPS:454787 | 0.27 | 0.05 | 1.8 | 0.69 | 0.07 | 9.5 |
| iPS:454789 | 0.29 | 0.02 | 1.7 | 1.19 | 0.74 | 5.5 |
| iPS:454791 | 0.44 | 0.08 | 1.2 | 0.79 | 0.05 | 7.1 |
| iPS:454793 | 0.39 | 0.18 | 1.3 | 1.09 | 0.24 | 6.0 |
| iPS:454795 | 0.37 | 0.12 | 1.4 | 3.26 | 1.04 | 2.0 |
| iPS:454797 | 0.20 | 0.01 | 2.6 | 1.21 | 0.25 | 5.4 |
| iPS:454799 | 0.32 | 0.08 | 1.6 | 1.59 | 1.12 | 4.1 |
| iPS:454801 | 0.44 | 0.26 | 1.2 | 1.82 | 0.35 | 4.4 |
| iPS:454803 | 0.44 | 0.32 | 1.2 | 0.92 | 0.57 | 8.7 |
| iPS:454805 | 0.52 | 0.24 | 1.0 | 1.16 | 0.02 | 6.9 |
| iPS:454807 | 0.56 | 0.20 | 0.9 | 1.48 | 0.20 | 5.4 |
| iPS:454809 | 0.64 | 0.04 | 0.8 | 2.01 | 0.08 | 4.0 |
| iPS:454811 | 0.53 | 0.18 | 1.0 | 2.85 | 0.22 | 2.8 |
| iPS:454813 | 0.61 | 0.31 | 0.8 | 0.81 | 0.13 | 9.9 |
| iPS:454815 | 0.37 | 0.11 | 1.6 | 0.65 | 0.07 | 10.1 |
| iPS:454817 | 0.33 | 0.10 | 1.7 | 0.62 | 0.11 | 10.7 |
| iPS:454819 | 0.33 | 0.09 | 1.8 | 0.69 | 0.01 | 9.6 |
| iPS:454821 | 0.39 | 0.13 | 1.5 | 0.72 | 0.09 | 9.2 |
| iPS:454823 | 0.39 | 0.12 | 1.5 | 0.80 | 0.15 | 8.3 |
| iPS:454825 | 0.29 | 0.11 | 2.0 | 0.79 | 0.13 | 8.4 |
| iPS:454827 | 0.34 | 0.13 | 1.7 | 0.75 | 0.06 | 8.9 |
| iPS:454829 | 0.36 | 0.12 | 1.8 | 0.70 | 0.05 | 9.8 |
| iPS:454831 | 0.38 | 0.09 | 1.7 | 0.90 | 0.15 | 7.6 |
| iPS:454833 | 0.24 | 0.17 | 2.6 | 0.76 | 0.11 | 9.0 |
| iPS:454835 | 0.28 | 0.16 | 2.2 | 0.73 | 0.10 | 9.3 |
| iPS:454837 | 0.45 | 0.11 | 1.4 | 1.01 | 0.07 | 6.8 |
| iPS:454839 | 0.36 | 0.20 | 1.8 | 0.79 | 0.00 | 8.6 |
| iPS:454841 | 0.46 | 0.18 | 1.4 | 0.78 | 0.05 | 8.8 |
| iPS:454843 | 0.42 | 0.07 | 1.6 | 0.93 | 0.36 | 5.8 |
| iPS:454845 | 0.40 | 0.13 | 1.7 | 0.66 | 0.11 | 8.2 |
| iPS:454847 | 0.43 | 0.10 | 1.5 | 0.80 | 0.17 | 6.7 |
| iPS:454849 | 0.55 | 0.23 | 1.2 | 1.48 | 0.06 | 3.6 |
| iPS:454851 | 0.37 | 0.11 | 1.8 | 0.76 | 0.06 | 7.1 |
| iPS:454853 | 0.47 | 0.20 | 1.4 | 0.93 | 0.30 | 5.8 |
| iPS:454855 | 0.46 | 0.20 | 1.4 | 0.81 | 0.07 | 6.6 |
| iPS:454857 | 1.36 | 0.69 | 0.5 | 0.57 | 0.12 | 11.2 |
| iPS:454859 | 1.50 | 0.59 | 0.4 | 1.91 | 0.87 | 3.3 |

TABLE 15-continued

| In vitro inhibitory potency of bispecific hetero-immunoglobulins | | | | | | |
|---|---|---|---|---|---|---|
| | Human CGRP Receptor | | | Human PAC1 Receptor | | |
| Molecule Designation | IC50 (nM) | SD | Fold-improvement over 4E4 Ab | IC50 (nM) | SD | Fold-improvement over 29G4v22 Ab |
| iPS:454861 | 1.54 | 0.84 | 0.4 | 1.34 | 0.57 | 4.8 |
| iPS:454863 | 1.50 | 0.69 | 0.4 | 1.40 | 0.11 | 4.5 |
| iPS:454865 | 1.59 | 0.68 | 0.4 | 1.63 | 0.43 | 3.9 |
| iPS:454867 | 1.55 | 0.38 | 0.4 | 0.98 | 0.17 | 6.5 |
| iPS:454869 | 1.65 | 0.73 | 0.4 | 1.10 | 0.03 | 5.8 |
| iPS:454871 | 2.30 | 0.57 | 0.2 | 1.74 | 0.46 | 3.3 |
| iPS:454873 | 2.13 | 0.57 | 0.2 | 1.32 | 0.31 | 4.4 |
| iPS:454875 | 1.70 | 0.14 | 0.3 | 3.00 | 0.11 | 1.9 |
| iPS:454877 | 1.49 | 0.38 | 0.3 | 0.80 | 0.06 | 7.2 |
| iPS:454879 | 1.37 | 0.39 | 0.3 | 0.86 | 0.04 | 6.7 |
| iPS:454881 | 0.93 | 0.02 | 0.5 | 0.53 | 0.05 | 10.9 |
| iPS:454883 | 1.03 | 0.24 | 0.5 | 0.64 | 0.09 | 9.0 |
| iPS:454885 | 1.16 | 0.43 | 0.5 | 0.61 | 0.06 | 10.5 |
| iPS:454887 | 1.86 | 1.72 | 0.3 | 0.69 | 0.06 | 9.3 |
| iPS:454889 | 1.10 | 0.49 | 0.5 | 1.31 | 0.13 | 4.9 |
| iPS:454891 | 0.90 | 0.22 | 0.6 | 0.68 | 0.05 | 9.5 |
| iPS:454893 | 1.35 | 0.34 | 0.4 | 0.87 | 0.01 | 7.4 |
| iPS:454895 | 1.41 | 0.47 | 0.4 | 0.69 | 0.15 | 9.4 |
| iPS:454897 | 1.14 | 0.59 | 0.5 | 1.04 | 0.26 | 6.2 |
| iPS:454899 | 1.04 | 0.26 | 0.6 | 1.41 | 0.34 | 5.2 |
| iPS:454901 | 1.01 | 0.09 | 0.6 | 0.67 | 0.06 | 10.9 |
| iPS:454903 | 1.16 | 0.25 | 0.5 | 0.72 | 0.17 | 10.2 |
| iPS:454905 | 1.13 | 0.53 | 0.5 | 0.79 | 0.10 | 9.2 |
| iPS:454907 | 1.63 | 0.28 | 0.4 | 1.37 | 0.11 | 5.4 |
| iPS:454909 | 1.49 | 0.10 | 0.4 | 0.77 | 0.14 | 9.5 |
| iPS:454911 | 1.98 | 0.49 | 0.3 | 0.81 | 0.04 | 9.1 |
| iPS:454913 | 2.11 | 1.36 | 0.3 | 1.33 | 0.36 | 5.2 |
| iPS:454915 | 1.25 | 0.32 | 0.4 | 0.66 | 0.21 | 10.5 |
| iPS:454917 | 1.34 | 0.88 | 0.4 | 0.61 | 0.23 | 11.4 |
| iPS:454919 | 1.40 | 0.23 | 0.4 | 0.70 | 0.03 | 9.8 |
| iPS:571009 (5602) | 0.43 | | 1.3 | 0.57 | | 7.2 |
| iPS:571015 (5603) | 0.47 | | 1.2 | 0.74 | | 5.5 |
| iPS:571017 (5604) | 0.45 | | 1.3 | 0.86 | | 4.8 |
| iPS:571025 (5605) | 0.60 | 0.16 | 0.9 | 1.34 | 0.37 | 3.1 |
| iPS:571023 (5607) | 0.63 | 0.13 | 0.9 | 0.88 | 0.37 | 4.4 |
| iPS:571033 (5608) | 0.33 | | 1.7 | 0.57 | | 7.2 |
| iPS:571824 (5609) | 0.38 | | 1.5 | 0.62 | | 6.6 |

The results show that when the affinity-matured anti-CGRP receptor antibody variants are reformatted into a bispecific hetero-immunoglobulin format, the majority of the molecules showed no loss of CGRP receptor blocking function relative to the bivalent 4E4 monoclonal antibody, despite the reduction in avidity. In fact, several of the molecules showed a 2- to 2.6-fold increase in potency as compared to the bivalent monoclonal antibody. Similarly, the bispecific hetero-immunoglobulin molecules exhibited enhanced inhibitory activity against the human PAC1 receptor relative to the bivalent 29G4v22 monoclonal antibody, despite the reduction in avidity. Generally, the bispecific hetero-immunoglobulin molecules were 2- to 12-fold more potent inhibitors of PAC1 receptor activity than the bivalent 29G4v22 monoclonal antibody. These results are somewhat surprising because although the bispecific hetero-immunoglobulin molecules have only monovalent binding to each target, they are more potent inhibitors of both receptors than conventional monoclonal antibodies, which have bivalent binding to each target. The enhanced potency of the bispecific hetero-immunoglobulin molecules against both targets enables a therapeutic approach to inhibit both receptor pathways with potentially lower dosage requirements than monospecific agents.

Example 3. Pharmacokinetic and Pharmacodynamic Characteristics of Anti-CGRP Receptor/Anti-PAC1 Receptor Hetero-Immunoglobulins in Rodents A single dose pharmacokinetic assessment of nine bispecific hetero-immunoglobulins was conducted in male CD-1 mice. The nine bispecific hetero-immunoglobulins tested in the study included: iPS:454557 (5601), iPS:571009 (5602), iPS:571015 (5603), iPS:571017 (5604), iPS:571025 (5605), iPS:454565 (5606), iPS:571023 (5607), iPS:571033 (5608), and iPS:571824 (5609). The test molecules were dosed to study animals by subcutaneous bolus administration at a dose of 1 mg/kg. Blood samples were collected at specified time points post-dose and processed to serum. All serum specimens were stored at approximately −70° C. (±10° C.) until transferred for subsequent analysis.

Both the total amount of bispecific hetero-immunoglobulin and intact bispecific hetero-immunoglobulin (i.e. intact heterotetramer) were measured in the mouse serum samples following dosing. Total bispecific molecule concentration in the mouse serum was measured using a sandwich immunoassay on the Gyrolab Workstation (Uppsala, Sweden). Standards (STD) and quality controls (QC) were prepared by spiking the test bispecific hetero-immunoglobulin into 100% mouse serum. Biotinylated murine monoclonal antibody against the human IgG Fc region (Amgen Inc., CA, USA), which recognizes the Fc region of the test bispecific hetero-immunoglobulin, was captured on microstructures containing a column of streptavidin-conjugated beads on a Gyros Bioaffy compact disc by the instrument. After a wash step, STD, QC, blank and study samples were added to the microstructures. After another wash to remove any unbound materials and prior to addition of the detection reagent, a background read of the microstructures was performed by the instrument. Alexa647 fluorescent dye-labeled murine monoclonal antibody against the human IgG Fc region (Amgen Inc., CA, USA) was added to the microstructures for the detection of captured test bispecific hetero-immunoglobulin molecules. After the final wash step the fluorescence reading was measured via laser-induced fluorescence through excitation at 633 nm and emission at 668 nm. The fluorescent signal, which was proportional to the amount of bispecific hetero-immunoglobulin bound, was measured by a photomultiplier tube (PMT) in the system. The concentration vs fluorescent signal is regressed according to a 4PL (Marquardt) regression model with a weighting factor of $1/Y^2$. The conversion of fluorescent signals for QC and study samples to concentrations was performed using current validated Watson LIMS (Thermo, PA, USA) data reduction software.

Intact bispecific molecule concentration in mouse serum was measured using an electrochemiluminescence (ECL) immunoassay. STD and QC were prepared by spiking the test bispecific hetero-immunoglobulin into 100% mouse serum. STD, QC, blank and study samples were added to a microtiter plate that had been passively coated with a mouse monoclonal antibody that recognizes the anti-PAC1 receptor arm of the test bispecific hetero-immunoglobulin molecules (Amgen Inc., CA, USA). After capture of the test bispecific molecules by the immobilized antibody, unbound materials were removed by a wash step. A biotin-conjugated soluble form of the human CGRP receptor (Amgen Inc., CA, USA), which binds the anti-CGRP receptor arm of the test bispecific hetero-immunoglobulin molecules, was added for detection of captured test bispecific molecules. After another wash step, MSD SULFO-TAG™ Labeled Streptavidin (Meso Scale Discovery, MD, USA) was added as a secondary detection reagent. After a final wash step, a tripropylamine read buffer (Meso Scale Discovery, MD, USA) was added to the plate. Ruthenium, which is part of the SULFO-TAG™, emits light at 620 nm when electrically stimulated and co-reacts with the tripropylamine buffer to enhance the signal. The signals were directly proportional to the amount of intact test bispecific molecule (i.e. molecule containing both the anti-CGRP receptor and anti-PAC1 receptor binding arms) bound by the capture reagent. The signal versus concentration relationship was regressed using a four-parameter logistic (Marquardt) regression model with a weighting factor of $1/Y^2$. The conversion of ECL counts for QC and test samples to concentrations was performed using the current validated Watson LIMS (Thermo, PA) data reduction software.

Figure 2:
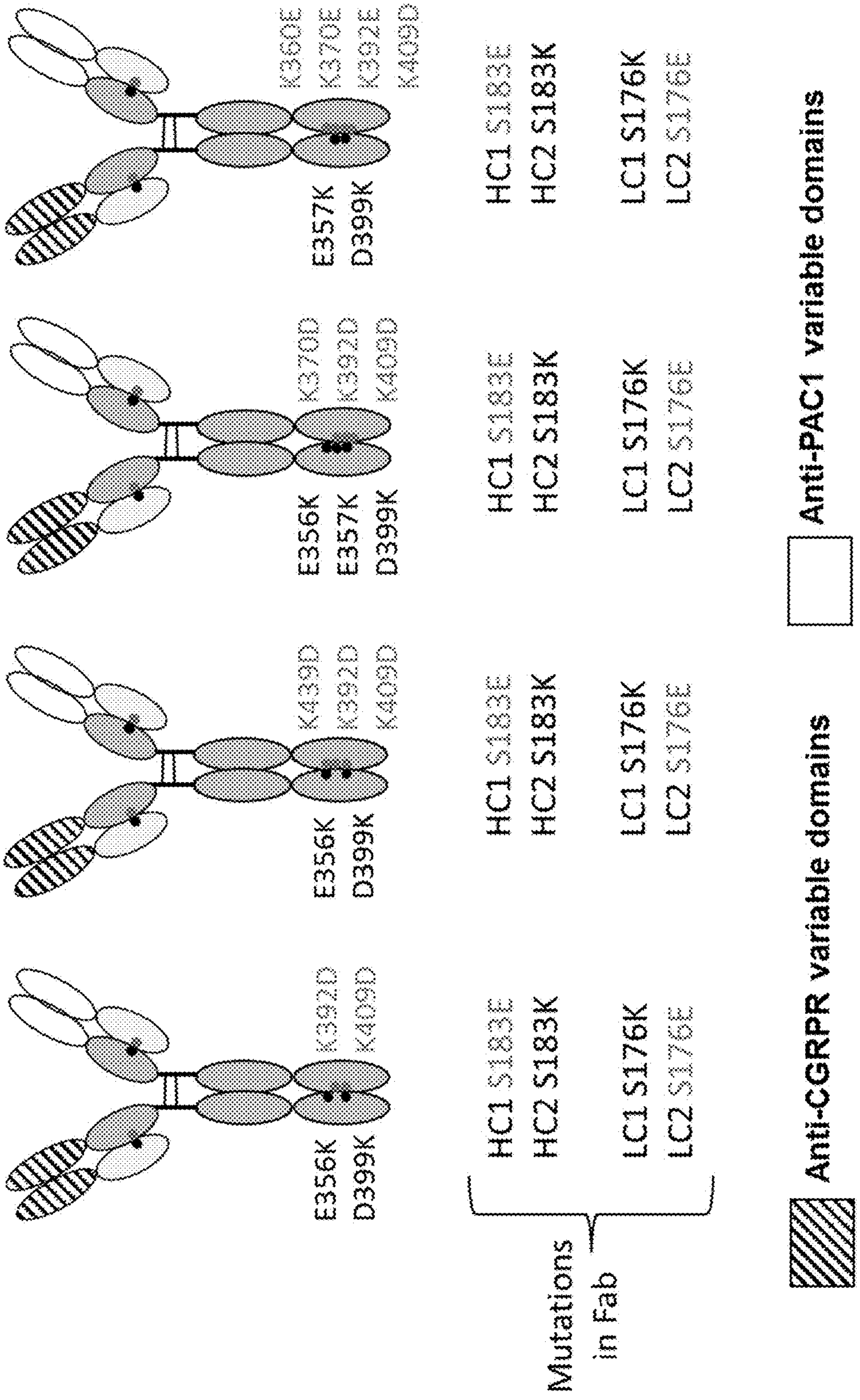
FIG. 2 shows a schematic representation of four charge pair mutation (CPM) formats used to generate anti-CGRP receptor/PAC1 receptor bispecific hetero-immunoglobulins. The Kabat-EU numbering scheme is used to denote the positions of charge pair mutations within each of the chains. This IgG-like bispecific molecule is a heterotetramer comprising two different light chains and two different heavy chains. HC1 and LC1 refer to the heavy chain and light chain, respectively, of one Fab binding arm and HC2 and LC2 refers to the heavy chain and light chain, respectively, of the second Fab binding arm. For example, in the schematic, HC1 and LC1 correspond to the anti-CGRP receptor binding arm and HC2 and LC2 correspond to the anti-PAC1 binding arm. However, the two binding arms can be switched such that HC1 and LC1 correspond to the anti-PAC1 binding arm and HC2 and LC2 correspond to the anti-CGRP receptor binding arm. The mutations at the indicated positions are shown with specific charged amino acids in the schematic, such as mutations to a glutamic acid or a lysine residue. However, other similarly charged amino acids can be used, such as an aspartic acid in place of glutamic acid (and vice versa) and an arginine residue in place of a lysine residue.
Figure 3A:
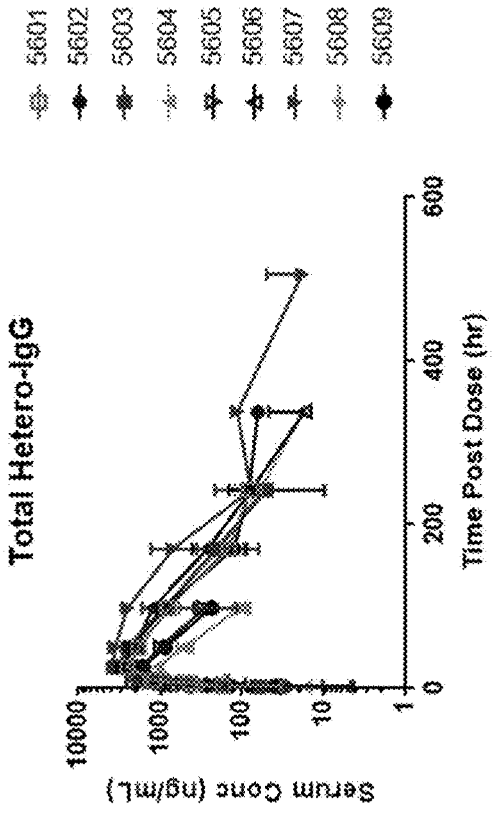
FIGS. 3A-3D are serum concentration-time profiles for bispecific hetero-immunoglobulin molecules following a single subcutaneous dose of 1 mg/kg in mice.
Figure 3B:
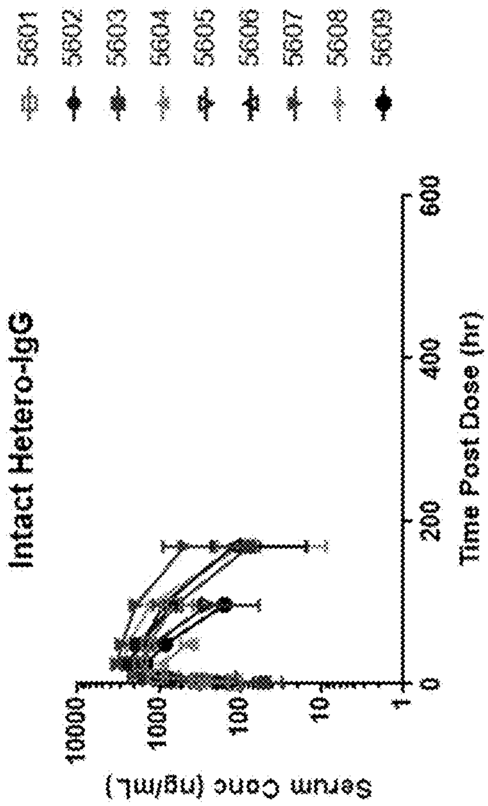
Figure 3C:
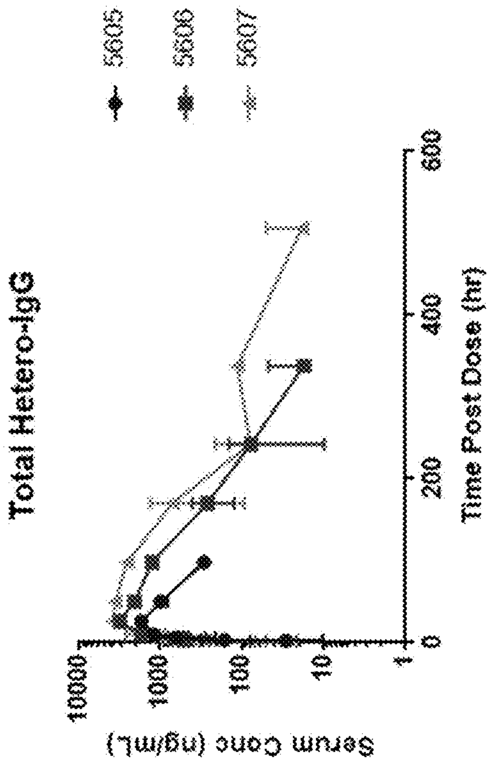
Figure 3D:
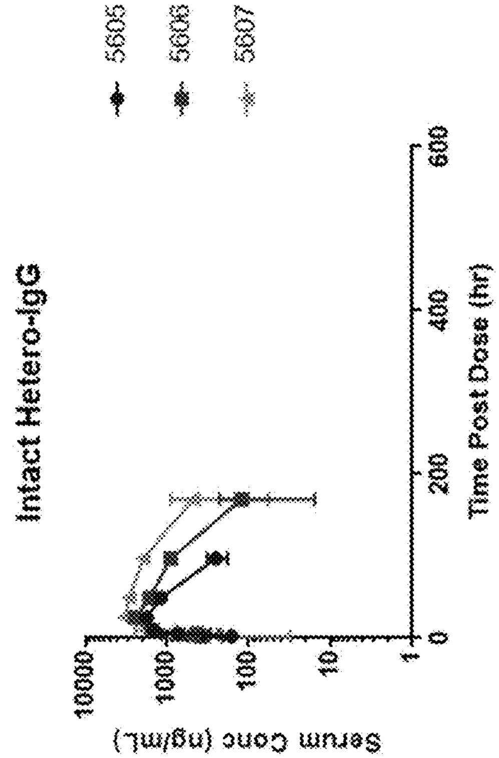

Noncompartmental analysis was performed on the mean serum test article concentration vs. nominal time data from all mice at each sampling time per dose group using Phoenix® WinNonlin® (version 6.4; Certara, NJ, USA). Individual concentration values less than the lower limit of quantification (LLOQ, 100 ng/mL for the intact assay and 50 ng/mL for the total assay) were reported as below the quantitation limit (BQL) and set to zero for the calculation of summary statistics. Mean concentration values less than the LLOQ were not reported or plotted. All concentration values less than the LLOQ were excluded from the noncompartmental analysis. Nominal doses and nominal sampling times were used for PK analysis. The total and intact serum concentrations of the test bispecific molecules are shown in FIGS. 3A and 3B, respectively. For the majority of the bispecific hetero-immunoglobulin molecules, intact molecules could be detected at nearly 100 hours following a single subcutaneous dose. The total and intact serum concentrations for three of the bispecific hetero-immunoglobulin molecules evaluated in pharmacodynamic assays described below and in Example 4 are shown in FIGS. 3C and 3D, respectively. All three of the bispecific hetero-immunoglobulin molecules 5605, 5606, and 5607 had the same variable regions, but differ in CPMs and other Fc mutations. Specifically, 5605 and 5607 have the CPM format v102 as shown in FIG. 2, whereas 5606 has the CPM format v101. Additionally, 5605 had M252Y, S254T, and T256E mutations to enhance circulation half-life by increasing the affinity of the molecules for the FcRn receptor. Bispecific molecules 5606 and 5607 had comparable pharmacokinetic profiles for the intact forms of the molecules, both of which were better than that for the intact form of the 5605 bispecific molecule in mice.

Variable regions from anti-PAC1 receptor antibodies (antibody 123 herein and antibody iPS:420943 in PCT/US19/13227) were combined with variable regions from an anti-CGRP receptor antibody (antibody 04 herein) to create IgG-Fab bivalent, bispecific molecules. In this IgG-Fab format, a polypeptide comprising either VL-CL domains or VH-CH1 domains from a first antibody is fused through a peptide linker to the carboxyl-terminus of the heavy chain of a second antibody to form a modified heavy chain. A second polypeptide comprising the remaining domains of the Fab fragment from the first antibody (i.e. VH-CH1 domains or VL-CL domains) is co-expressed with the light chain of the second antibody and the modified heavy chain to produce the complete molecule. Assembly of the full molecule creates a tetravalent binding protein having two antigen binding domains against a first target located on the amino terminal side of a dimerized immunoglobulin Fc region and two antigen binding domains against a second target located on the carboxyl terminal side of the dimerized Fc region.

The pharmacokinetic profiles of these IgG-Fab molecules were also assessed in mice using a similar protocol as described above for the bispecific hetero-immunoglobulins. The IgG-Fab molecules were also dosed subcutaneously at 1 mg/kg in male CD-1 mice. The total concentration of the hetero-immunoglobulins in mouse serum was about 10-fold higher on average (molar basis, corrected for dose) than the total concentration for the IgG-Fab molecules (data not shown). The serum concentration for intact IgG-Fab molecules (i.e. binding domains for both targets intact) was below the limit of detection at all time points, suggesting that the IgG-Fab molecules lose at least one of their binding domains in vivo. Thus, for bispecific molecules with target specificities for human CGRP receptor and human PAC1 receptor, the hetero-immunoglobulin format appears to have a more desirable pharmacokinetic profile than the IgG-Fab format.

Next, three bispecific hetero-immunoglobulin molecules (molecules 5605, 5606, and 5607) were evaluated for efficacy in inhibiting PAC1 receptor activation in vivo using a rat dermal blood flow model. Maxadilan is a vasodilatory peptide and an agonist of the PAC1 receptor. When administered intradermally, maxadilan causes an increase in local dermal blood flow that can be measured by laser Doppler imaging. Inhibition of this effect by PAC1 antagonists can serve as a translational pharmacodynamic model of antagonism of PAC1 biological activity. The activity of the bispecific hetero-immunoglobulin molecules against the CGRP receptor could not be evaluated in the rat model as the CGRP receptor binding arm of the molecules does not significantly bind to the rat CGRP receptor.

The bispecific hetero-immunoglobulin molecules were tested in a rat maxadilan-induced increase in dermal blood flow (MIIBF) pharmacodynamic (PD) model with a laser Doppler imaging. Naive male Sprague Dawley rats aged at 8-12 weeks were used for the study. A dosing solution of maxadilan (Bachem, H6734.0500) was prepared fresh daily by diluted maxadilan stock solution (0.5 mg/mL) in ix phosphate-buffered saline (PBS) to a final concentration of 0.5 μg/mL. All bispecific hetero-immunoglobulin molecules (heteroIgGs) were prepared in 10 mM sodium-acetate, 9% sucrose, pH 5.2 (A52Su) at different concentrations, depending on the dose required for the experiment, and administered via a single bolus i.v. injection one day prior to the dermal blood flow (DBF) measurement by the laser Doppler imaging.

A laser Doppler imager (LDI-2, Moor Instruments, Ltd, Wilmington, DE) was used to measure DBF on a shaved patch of skin of the rat abdomen using a low-power laser beam generated by a 633 nm helium-neon bulb. The measurement resolution was 0.2 to 2 mm, with a scanning distance between the instrument aperture and the tissue surface of 30 cm. DBF was measured and expressed as either % change from baseline [100×(individual post-maxadilan flux-individual baseline flux)/individual baseline flux] or % DBF inhibition [Mean of vehicle % change from BL−individual antibody treated rat % change from BL)/ Mean of vehicle % change from BL] to quantify the magnitude of the heteroIgG molecule effect.

On the test day, following anesthetization with propofol, the rat's abdominal area was shaved and each animal was placed in a supine position on a temperature-controlled circulating warm-water pad to maintain a stable body temperature during the study. After a 10 to 15 minute stabilization period, a rubber O-ring (0.925 cm inner diameter, 0-Rings West, Seattle, WA) was placed on the rat abdomen (without directly positioning it over a visible blood vessel). After placement of the O-ring on the selected area, a baseline (BL) DBF measurement was taken. After the BL scan, the PAC1 agonist maxadilan was administered by intradermal injection (20 of 0.5 μg/mL) at the center of the O-ring. DBF was measured 30 min following maxadilan injection, or 24±1.5 hours following heteroIgG molecule treatment. The O-ring defines the area of interest in which the DBF was analyzed.

All DBF results were expressed as the mean±SEM. A one-way ANOVA followed by Dunnett's Multiple Comparison Test (MCT) was used to assess the statistical significance of HeteroIgG molecule effects relative to vehicle treatment. A p value of <0.05 was used to determine significance between two groups.

Figure 4A:
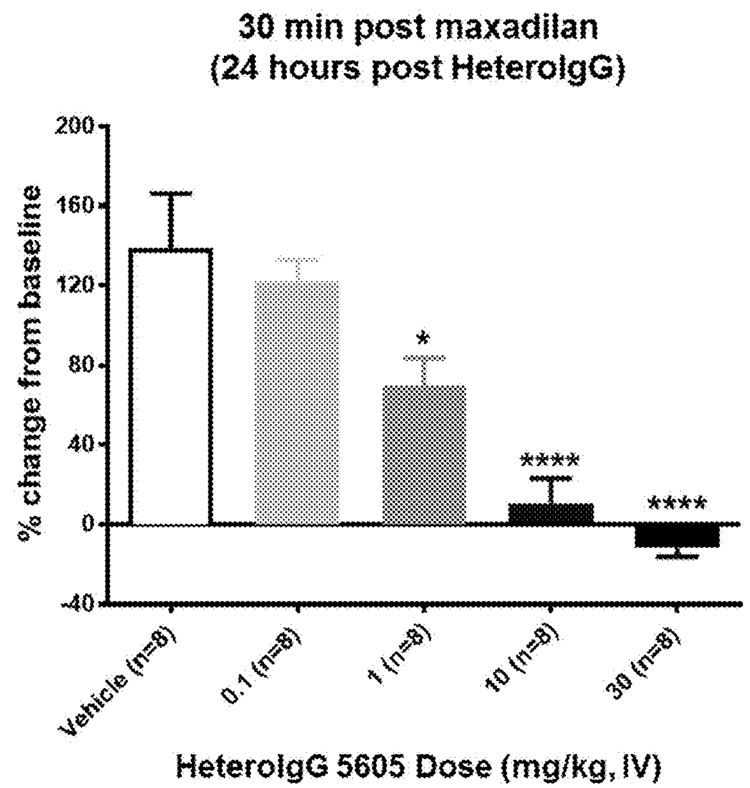
FIG. 4A shows the dose-dependent effect of bispecific hetero-immunoglobulin molecule (heteroIgG) 5605 on maxadilan-induced increase in dermal blood flow in rats. The heteroIgG was administered to rats intravenously at one of four doses ranging from 0.1 mg/kg to 30 mg/kg twenty-four hours prior to challenge with 10 ng maxadilan (intradermal injection). Dermal blood flow was assessed 30 minutes following maxadilan challenge with laser Doppler imaging. *p<0.05, ****p<0.0001 compared to the vehicle group with One-Way ANOVA followed by Dunnett's MCT.
Figure 4B:
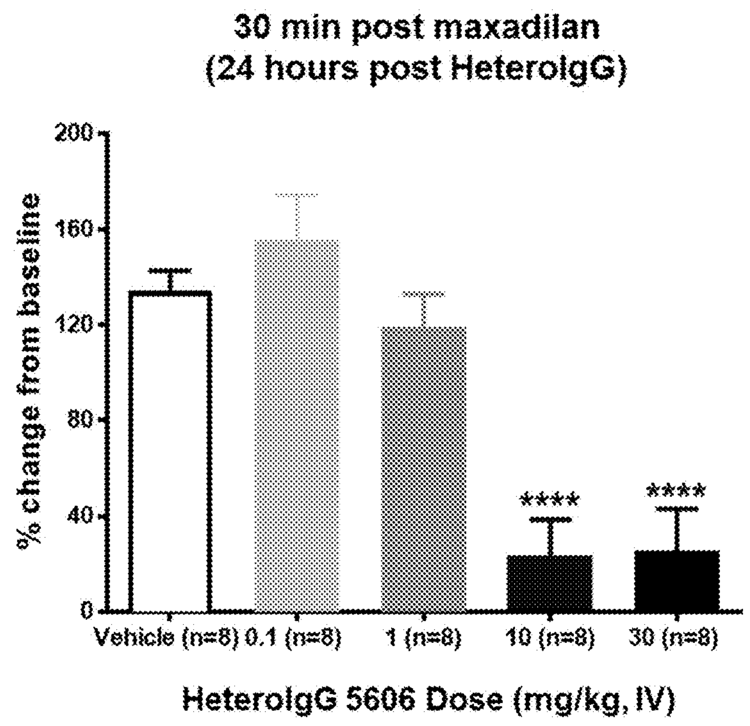
FIG. 4B shows the dose-dependent effect of bispecific hetero-immunoglobulin molecule (heteroIgG) 5606 on maxadilan-induced increase in dermal blood flow in rats. The heteroIgG was administered to rats intravenously at one of four doses ranging from 0.1 mg/kg to 30 mg/kg twenty-four hours prior to challenge with 10 ng maxadilan (intradermal injection). Dermal blood flow was assessed 30 minutes following maxadilan challenge with laser Doppler imaging. ****p<0.0001 compared to the vehicle group with One-Way ANOVA followed by Dunnett's MCT.
Figure 4C:
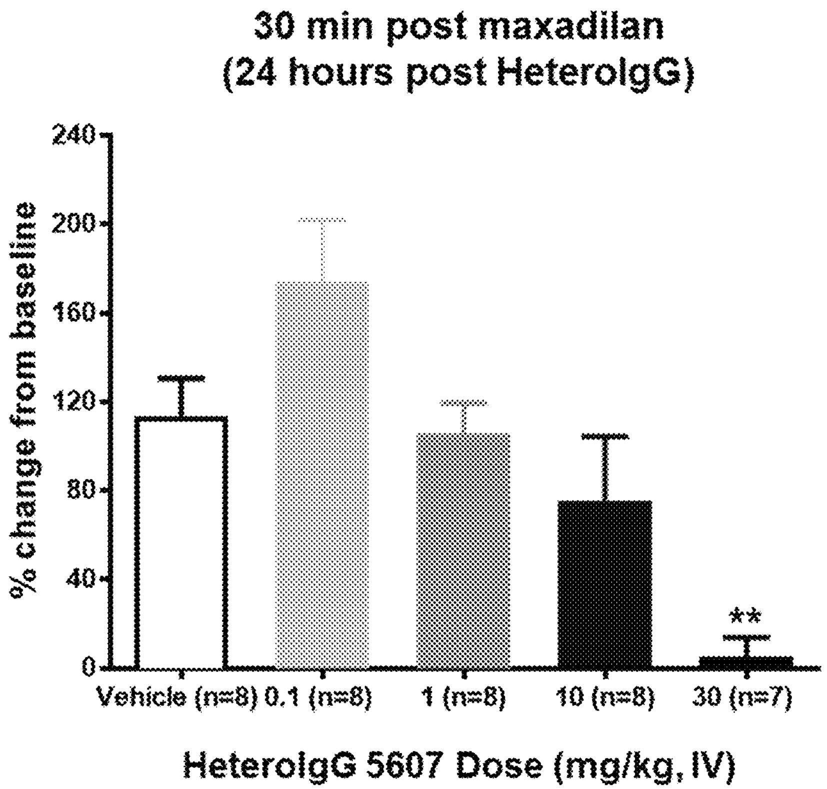
FIG. 4C shows the dose-dependent effect of bispecific hetero-immunoglobulin molecule (heteroIgG) 5607 on maxadilan-induced increase in dermal blood flow in rats. The heteroIgG was administered to rats intravenously at one of four doses ranging from 0.1 mg/kg to 30 mg/kg twenty-four hours prior to challenge with 10 ng maxadilan (intradermal injection). Dermal blood flow was assessed 30 minutes following maxadilan challenge with laser Doppler imaging. **p<0.01 compared to the vehicle group with One-Way ANOVA followed by Dunnett's MCT.

Rats were pretreated with 3 different heteroIgG molecules (5605, 5606, and 5607) 24 hours prior to maxadilan challenge (20 μl of 0.5 μg/mL) at a dose ranging from 0.1 mg/kg to 30 mg/kg. A dose-dependent reduction of MIIBF compared to vehicle-treated group was observed for each of the three bispecific hetero-immunoglobulin molecules (FIGS. 4A-4C). HeteroIgG 5605 was the most potent of the three molecules tested showing a significant effect compared to vehicle at a dose of 1 mg/kg. All three molecules produced greater than 75% inhibition of maxadilan-induced DBF at a dose of 30 mg/kg. The results of this experiment demonstrate that bispecific heteroIgG molecules that potently inhibit ligand-induced PAC1 receptor activation in vitro also inhibit PAC1 receptor activation in vivo as assessed by the dermal blood flow assay, a model of PAC1-mediated vasodilation.

Example 4. Pharmacokinetic and Pharmacodynamic Characteristics of Anti-CGRP Receptor/Anti-PAC1 Receptor Hetero-Immunoglobulins in Cynomolgus Monkeys A pharmacokinetic study of three bispecific hetero-immunoglobulin molecules (heteroIgG molecules 5605, 5606, and 5607) was conducted in naïve female cynomolgus monkeys. The test heteroIgG molecules were dosed to study animals by either intravenous bolus administration at a dose of 1 mg/kg or subcutaneous bolus administration at a dose of 2 mg/kg. Blood samples were collected at specified time points post-dose and processed to serum. All serum specimens were stored frozen at −60° C. to −90° C. until transferred for subsequent analysis.

The concentration of the heteroIgG molecules in cynomolgus monkey serum was measured using an electrochemiluminescence (ECL) immunoassay. This method assesses the concentration of intact heteroIgG molecules, i.e. molecules that contain both the anti-CGRP receptor and anti-PAC1 receptor binding arms. Standards (STD) and quality controls (QC) were prepared by spiking the heteroIgG molecule into 100% cynomolgus monkey serum. STD, QC, blank and study samples were added to a plate that had been passively coated with a mouse monoclonal antibody directed against the anti-CGRP receptor arm of the test bispecific hetero-immunoglobulin molecules (Amgen Inc., CA, USA). After capture of the bispecific hetero-immunoglobulin to the immobilized antibody, unbound materials were removed by a wash step. Biotin conjugated to a mouse monoclonal antibody against the anti-PAC1 receptor arm of the test bispecific hetero-immunoglobulin molecules (Amgen Inc., CA, USA) was added for detection of captured bispecific hetero-immunoglobulin molecules. After another wash step, MSD SULFO-TAG™ Labeled Streptavidin (Meso Scale Discovery, MD, USA) was added as a secondary detection reagent. After a final wash step, a tripropylamine read buffer (Meso Scale Discovery, MD, USA) was added to the plate. Ruthenium, which is part of the SULFO-TAG™, emits light at 620 nm when electrically stimulated and co-reacts with the tripropylamine buffer to enhance the signal. The signals were directly proportional to the amount of intact test bispecific molecule (i.e. molecule containing both the anti-CGRP receptor and anti-PAC1 receptor binding arms) bound by the capture reagent. The signal versus concentration relationship was regressed using a four-parameter logistic (Marquardt) regression model with a weighting factor of $1/Y^2$. The conversion of ECL counts for QC and test samples to concentrations was performed using the current validated Watson LIMS (Thermo, PA) data reduction software.

Noncompartmental analysis was performed on the mean serum test article concentration vs. nominal time data from all cynomolgus monkeys at each sampling time per dose group using Phoenix® WinNonlin® (version 6.4; Certara, NJ, USA). Individual concentration values less than the lower limit of quantification (LLOQ, 10 ng/mL) were reported as below the quantitation limit (BQL) and set to zero for the calculation of summary statistics. Mean concentration values less than the LLOQ were not reported or plotted. All concentration values less than the LLOQ were excluded from the noncompartmental analysis. Nominal doses and nominal sampling times were used for PK analysis.

Figure 5A:
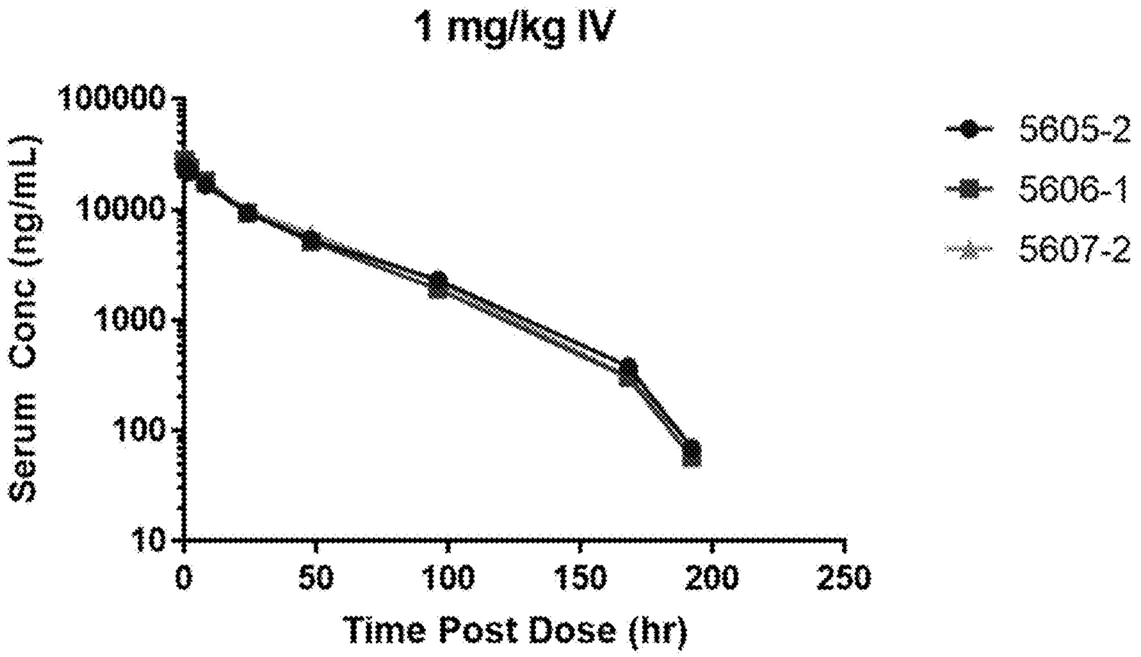
FIG. 5A is the serum concentration-time profile for bispecific hetero-immunoglobulin molecules 5605, 5606, and 5607 following a single intravenous dose of 1 mg/kg in cynomolgus monkeys.
Figure 5B:
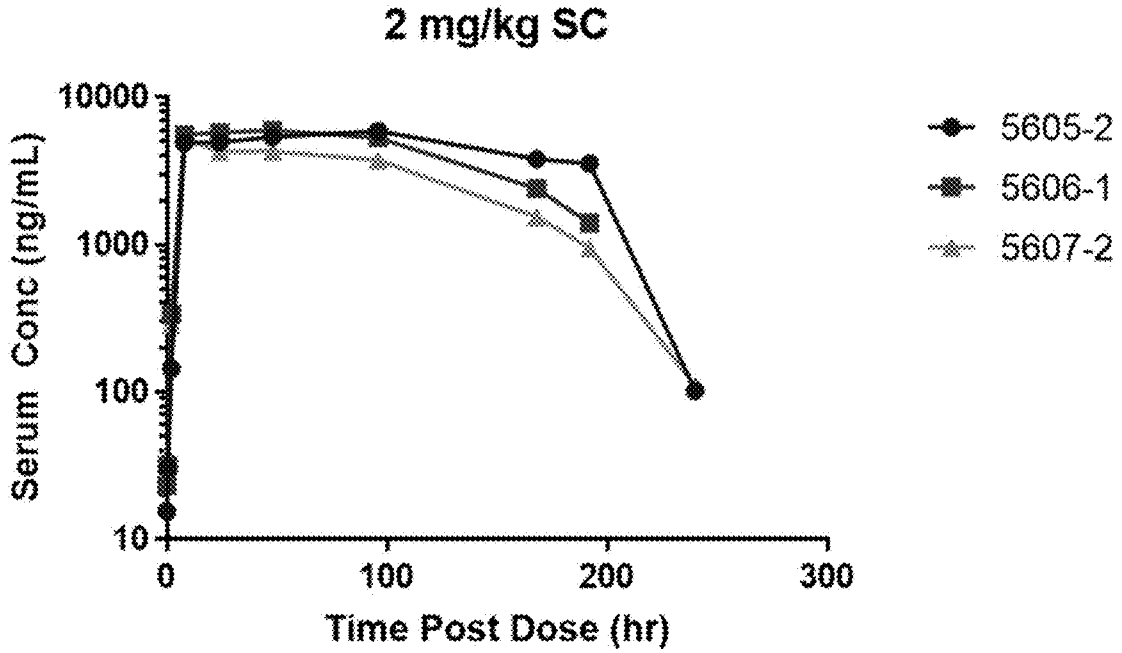
FIG. 5B is the serum concentration-time profile for bispecific hetero-immunoglobulin molecules 5605, 5606, and 5607 following a single subcutaneous dose of 2 mg/kg in cynomolgus monkeys.

Cynomolgus monkeys were administered one of the three heteroIgG molecules intravenously at a dose of 1 mg/kg or subcutaneously at a dose of 2 mg/kg. Blood samples were collected at various time points after dosing and intact heteroIgG molecule concentration was measured in serum samples at each of the time points using the ECL immunoassay described above. PK parameters for the intravenous route of administration are summarized in Table 16 and PK parameters for the subcutaneous route of administration are summarized in Table 17 below. The serum concentration-time profiles are shown in FIGS. 5A and 5B.

TABLE 16

Summary of PK Parameters for IV-administered Bispecific Hetero-Immunoglobulins in Cynomolgus Monkeys

| Molecule Designation | No. of Animals | Dose (mg/kg) | $AUC_{0-last}$ (μg * hr/L) | $AUC_{0-inf}$ (μg * hr/L) | $T_{1/2}$ (hr) | CL (L/hr/kg) | Vss (L/kg) |
|---|---|---|---|---|---|---|---|
| 5605 (iPS:571025) | 2 | 1 | 792000 | 802000 | 29.6 | 0.00126 | 0.0515 |
| 5606 (iPS:454565) | 2 | 1 | 778000 | 789000 | 27.3 | 0.00127 | 0.049 |
| 5607 (iPS:571023) | 2 | 1 | 847000 | 855000 | 28.4 | 0.00118 | 0.0453 |

TABLE 17

Summary of PK Parameters for SC-administered Bispecific Hetero-Immunoglobulins in Cynomolgus Monkeys

| Molecule Desig-nation | No. of Ani-mals | Dose (mg/kg) | $AUC_{0-last}$ (μg * hr/L) | $AUC_{0-inf}$ (μg * hr/L) | $T_{1/2}$ (hr) | Cmax (ng/mL) | Tmax (hr) | % F |
|---|---|---|---|---|---|---|---|---|
| 5605 (iPS: 571025) | 2 | 2 | 968000 | 1880000 | 204 | 5890 | 96 | 61% |
| 5606 (iPS: 454565) | 2 | 2 | 830000 | 946000 | 52.4 | 5990 | 48 | 53% |
| 5607 (iPS: 571023) | 2 | 2 | 616000 | 654000 | 50.3 | 5280 | 8 | 36% |

The results of the study show that there were no significant differences in pharmacokinetic characteristics among the three bispecific heterodimeric antibodies following IV administration. The $C_{max}$ values were similar for the three bispecific heterodimeric antibodies following subcutaneous administration and bioavailability for the molecules ranged from 36% to 61%.

To evaluate the in vivo efficacy of the bispecific heteroIgGs to inhibit activation of both the CGRP receptor and PAC1 receptor, a single dose of heteroIgG molecule 5607 was intravenously administered to cynomolgus monkeys and evaluated for efficacy in preventing dermal vasodilation induced by the PAC1 receptor agonist, maxadilan, and the TRPV1 receptor agonist, capsaicin, as assessed by Laser Doppler Imaging. Activation of the TRPV1 receptor by capsaicin results in the release of CGRP and activation of peripheral CGRP receptors, which in turn leads to increases in dermal blood flow. Inhibition of capsaicin-induced increases in dermal blood flow has been extensively used as a translational model to assess the pharmacological effect of CGRP receptor antagonists. Likewise, inhibition of maxadilan-induced dermal blood flow can serve as a translational pharmacodynamic model of antagonism of PAC1 receptor biological activity.

On Day 0 of the study, male cynomolgus monkeys were anesthetized and positioned for laser Doppler scans. The change in dermal blood flow (DBF) was used as a screening method to enroll animals that are deemed responders to the maxadilan-induced and capsaicin-induced increase in blood flow. Two to four O-rings were positioned on the ventral surface of the forearm or medial skin of the thigh for area selection scan (up to 2 for the forearm and up to 4 for the thigh). Each animal had a baseline laser Doppler scan of the limb. Following the completion of the baseline scan, maxadilan was administered by an intradermal injection (1 ng in 20 μL) on the limb, followed by the post challenge agent scans every 5 min for 30 min. After the completion of scans, the change in dermal blood flow was determined by averaging the flux units for all replicates at each time point and calculating the difference in flux units 30 min post challenge agent injection compared to the baseline (pre-challenge) DBF. Animals were then assessed for the response to capsaicin on a different limb. The same scanning procedures as described above were used, except that capsaicin was administered topically at 1 mg in 20 μL. Animals were included in the study upon on a change in dermal blood flow ≥60 flux units to both challenge agents. Each animal selected from the pre-screening was administered a single intravenous dose of bispecific heteroIgG molecule 5607 at 10 mg/kg via an infusion pump with the rate of 1 mL/min while still under anesthesia. After the dose administration, the animal was allowed to recover from anesthesia and then returned to its home cage.

Each animal was subject to DBF measurements post administration of the bispecific heteroIgG molecule on Day 2, Day 4 or Day 5 & Day 8 or Day 9. Six animals were tested on Day 4 and Day 8, whereas two animals were tested on Day 5 and Day 9 due to the screening schedule. On the scheduled day for DBF measurements, the animals were anesthetized and subject to baseline DBF measurements and DBF measurements up to 30 min following administration of maxadilan or capsaicin challenge agents. A different limb was used for the measurements with the second challenge agent than that used with the first challenge agent. Blood samples were obtained pre-dose with the bispecific heteroIgG molecule and 30 min, 1 day, 2 days, 4 days, and 8 days post-dose for pharmacokinetic analysis.

Figure 6A:
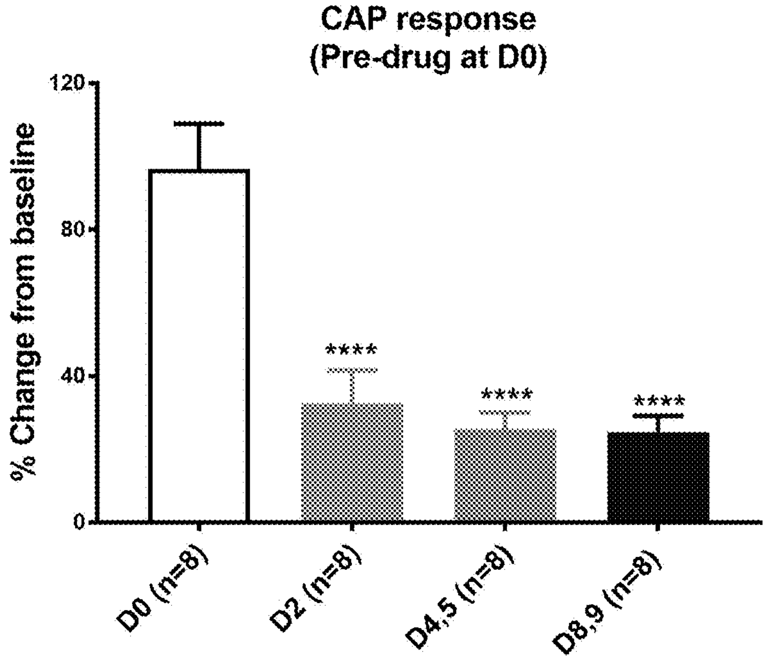
FIG. 6A shows the dose-dependent effect of bispecific hetero-immunoglobulin molecule (heteroIgG) 5607 on capsaicin-induced increase in dermal blood flow in cynomolgus monkeys. Following a pre-treatment measurement on Day 0, the heteroIgG was administered to cynomolgus monkeys intravenously at a single dose of 10 mg/kg. Dermal blood flow was assessed 30 minutes following capsaicin challenge (1 mg in 20 μL, topical application) with laser Doppler imaging on Day 2, Day 4/5, and Day 8/9 following administration of the heteroIgG. Data is shown as the mean±SEM. p<0.01, **p<0.0001 compared to Day 0 with One-Way ANOVA followed by Bonferroni's MCT.
Figure 6B:
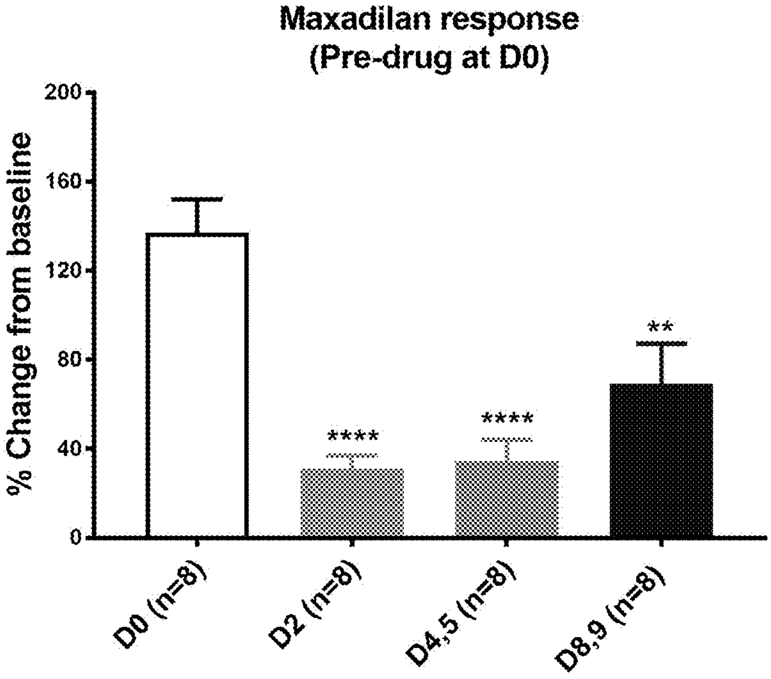
FIG. 6B shows the dose-dependent effect of bispecific hetero-immunoglobulin molecule (heteroIgG) 5607 on maxadilan-induced increase in dermal blood flow in cynomolgus monkeys. Following a pre-treatment measurement on Day 0, the heteroIgG was administered to cynomolgus monkeys intravenously at a single dose of 10 mg/kg. Dermal blood flow was assessed 30 minutes following maxadilan challenge (1 ng in 20 μL, intradermal injection) with laser Doppler imaging on Day 2, Day 4/5, and Day 8/9 following administration of the heteroIgG. Data is shown as the mean±SEM. p<0.01, **p<0.0001 compared to Day 0 with One-Way ANOVA followed by Bonferroni's MCT.

The effect of bispecific heteroIgG molecule 5607 on capsaicin-induced DBF is shown in FIG. 6A, whereas the effect of bispecific heteroIgG molecule 5607 on maxadilan-induced DBF is shown in FIG. 6B. As shown in FIG. 6A, a single dose of the bispecific heteroIgG molecule significantly inhibited capsaicin-induced DBF up to 8 or 9 days following administration, suggesting that the molecule inhibits activation of peripheral CGRP receptors. Similarly, a single dose of the bispecific heteroIgG molecule also significantly inhibited maxadilan-induced DBF up to 8 or 9 days following administration, indicating that the molecule inhibits activation of peripheral PAC1 receptors as well. See FIG. 6B. The results of this experiment demonstrate that the bispecific heteroIgG molecule 5607 inhibits both CGRP receptor and PAC1 receptor activation in vivo in cynomolgus monkeys.

Example 5. Crystal Structure-Guided Design of Improved Functional Variants of Human CGRP Receptor Antibodies The 4E4 Fab (VH region of SEQ ID NO: 47; VL region of SEQ ID NO: 23) fragment was co-crystallized in complex with a soluble CGRP receptor that comprised the extracellular domains (ECDs) of human CRLR and human RAMP1. Specifically, the soluble CGRP receptor comprised amino acid residues 23-133 of the human CRLR polypeptide (SEQ ID NO: 1) and amino acid residues 26-117 of the human RAMP1 polypeptide (SEQ ID NO: 2). See, e.g., Koth et al., Biochemistry, Vol. 49: 1862-1872, 2010. The two soluble polypeptides were expressed in *E. coli* and isolated from inclusion bodies. The CRLR and RAMP1 soluble proteins were mixed together at 1:1 molar ratio and diluted to 500 mL with 8M Urea. Co-refolding was performed by 20× rapid dilution with 10 L of 0.1 M Arginine, 1.2 M Urea, 50 mM Phosphate pH 8.0 with 1.5 mM glutathione/0.5 mM glutathione disulfide and incubated for one day. The co-refolded protein sample was concentrated to 500 mL, and diafiltrated with 50 mM Tris, 150 mM NaCl, pH 8.0. The co-refolded protein was purified by Ni-NTA affinity resin, followed by Superdex 200 SEC (GE Life Sciences) in 50 mM Tris, 150 mM 420 NaCl, 10% Glycerol, 1 mM DTT, 1 mM EDTA, pH 8.0. The soluble CGRP receptor was subsequently utilized for complex formation and crystallization with the 4E4 Fab fragment.

The soluble CGRP receptor and the 4E4 Fab fragment were incubated in a 1.5:1 molar ratio at 4° C. overnight and then treated with Thrombin 1U/100 μg protein (Sigma-Aldrich) for 8 hours. The complex was purified to homogeneity on a Superdex200 SEC column in 20 mM Tris, 50 mM NaCl, pH 8.0. Selected fractions containing the soluble CGRP receptor/4E4 Fab fragment 1:1 complex were pooled together and concentrated to 16 mg/mL. Sitting drop vapor diffusion co-crystallization experiments were performed using a Mosquito robot (TTP Labtech). The crystallization drops were mixed 1:1 with 0.4 μL protein to 0.4 μL reservoir solution, consisting of an extensive array of commercially available crystallization screens (Hampton, Qiagen, Molecular Dimensions) at 20° C. Crystallization trials were set up with and without the addition of 2-fold molar excess of Protein L. A crystal of the complex of the soluble CGRP receptor and the 4E4 Fab fragment grew in 21 days from the Morpheus screen (Molecular Dimensions/Anatrace) condition (0.12 M Ethylene Glycol, 0.1 M HEPES:MOPS pH 7.5, 37.5% MPD_PEG1K_PEG3350.

The crystal of the CGRP receptor/4E4 Fab complex was equilibrated in the crystallization buffer as a cryoprotectant, prior to freezing in liquid nitrogen. The data set was collected on a home source Rigaku FR-E SuperBright rotating anode generator using CrystalClear data collection software and a Saturn92 CCD detector with VariMax HF optics at wavelength 1.5418 Å and temperature 100K. The data were integrated and scaled using HKL2000 (Otwinowski and Minor, Methods Enzymology, Vol. 276, 307-326, 1997). The crystal belongs to the primitive monoclinic space group P 1 21 1 with unit cell dimensions of a=70.5 Å, b=112.5 Å, c=77.3 Å, α=90°, β=91.84°, γ=90°. The structure was solved via molecular replacement using structurally-related Fab variable and constant domains as the initial search model, and subsequent molecular replacement iterations using CRLR and RAMP1 (PDB ID: 3N7P) (ter Haar et al., Structure, Vol. 18: 1083-1093, 2010) as search models. The molecular replacement solutions were achieved with Phaser (McCoy et al., J Appl Crystallogr, Vol. 40: 658-674, 2007) and MolRep (Vagin and Teplyakov, Acta Crystallogr D Biol Crystallogr, Vol. 66: 22-25, 2010) in the CCP4 program suite (Winn et al., Acta Crystallogr D Biol Crystallogr, Vol. 67: 235-242, 2011). Iterative refinement cycles were performed using Refmac5 (Murshudov et al., Acta Crystallogr D Biol Crystallogr, Vol. 67: 355-367, 2011) in the CCP4 suite and the Phenix.refine module in PHENIX (Adams et al., Acta Crystallogr D Biol Crystallogr, Vol. 66: 213-221, 2010) and model building was performed in Coot (Emsley et al., Acta Crystallogr D Biol Crystallogr, Vol. 66: 486-501, 2010). The structure of the CGRP receptor/4E4 Fab complex was refined to 2.70 Å with an R-factor of 24.5% and $R_{free}$ of 28.2%. Ramachandran statistics were calculated as 96.7% favored, 3.3% allowed, with no outliers using MolProbity (Davis et al., Nucleic Acids Res, Vol. 35, W375-383, 2007). Buried surface areas were all calculated using PISA (Krissinel and Henrick, J. Mol Biol, Vol. 372: 774-797, 2007).

Figure 7A:
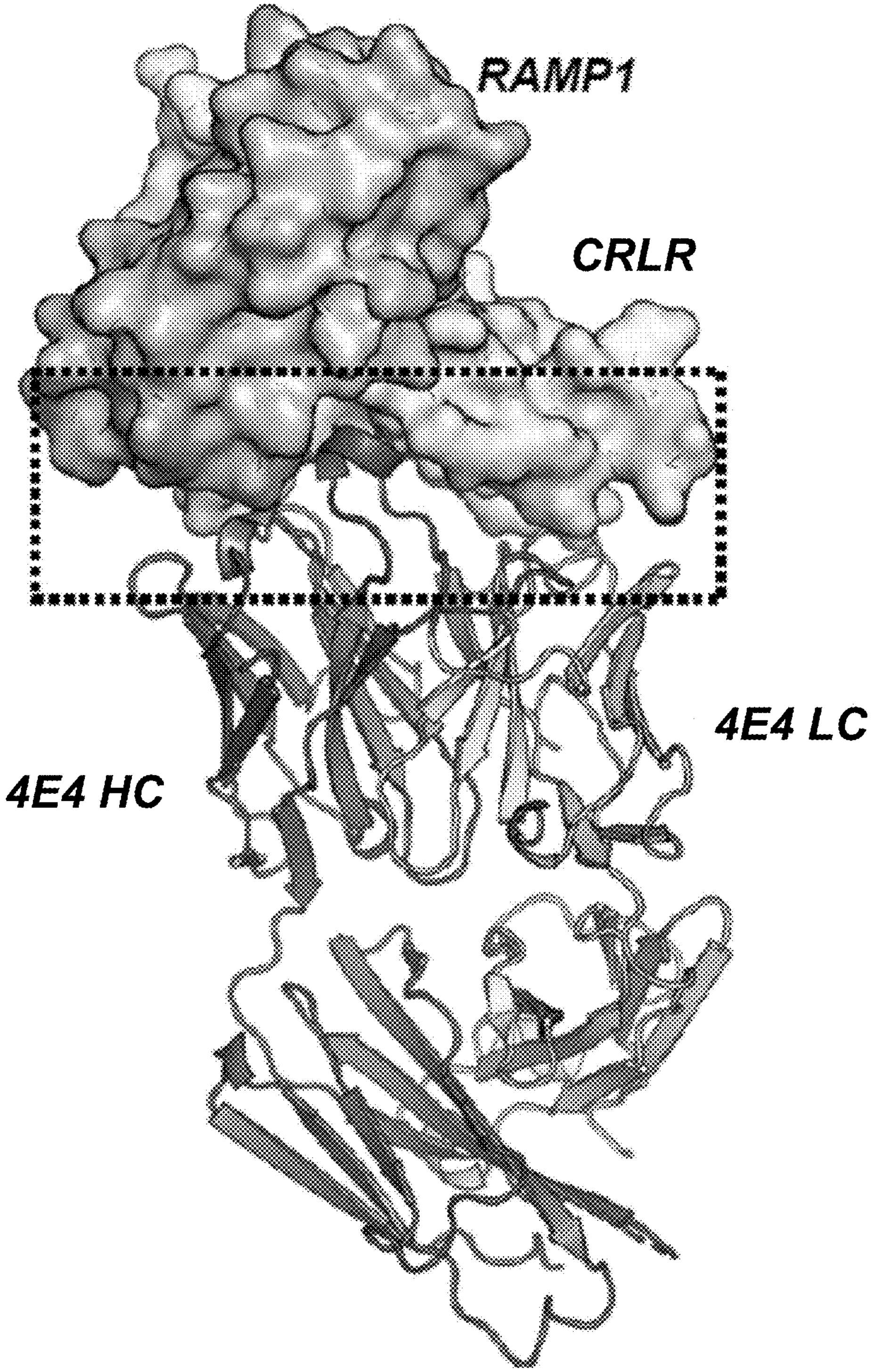
FIG. 7A depicts the ternary complex of the 4E4 Fab fragment (ribbon structure representation with heavy chain (HC) on the left and light chain (LC) on the right) bound to CRLR ECD polypeptide (surface representation in light gray) and RAMP1 ECD polypeptide (surface representation in medium gray). The dashed box highlights the paratope-epitope interface.
Figure 7B:
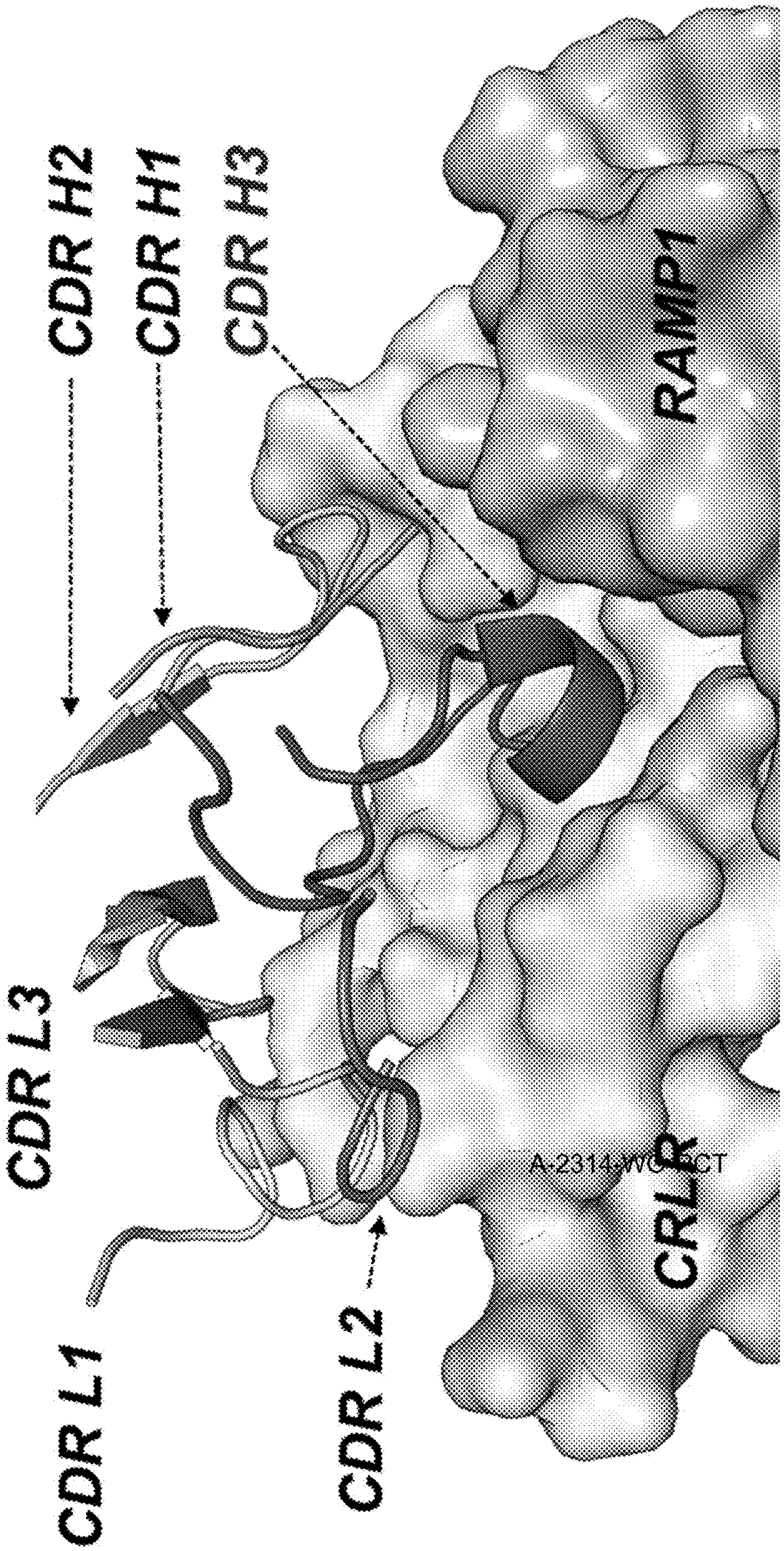
FIG. 7B is an expanded view of the paratope-epitope interface showing the interaction of each of the six CDRs in the 4E4 Fab fragment with the CRLR and RAMP1 polypeptide components of the CGRP receptor. The view shows the region delineated by the dashed box in FIG. 7A rotated 90° about the horizontal axis and 45° about the vertical axis.

The structure of the CGRP receptor/4E4 Fab complex reveals that the 4E4 Fab fragment interacts with both CRLR and RAMP1 polypeptide components of the CGRP receptor (FIGS. 7A and 7B). A closeup view of the paratope/epitope interface shows all six CDRs making direct contacts with the epitope (FIG. 7B). Notably, the 21-amino acid long CDRH3 (SEQ ID NO: 43) exhibits a distinct secondary structure at the tip that appears buried deep into a pocket composed of the CRLR/RAMP1 interface (FIG. 7B). To determine the individual contribution of each of the CDRs to recognize and bind to the CGRP receptor, the corresponding buried surface ($Å^2$) for each CDR was calculated. The data indicate that most of the buried paratope into CGRP receptor comes from the heavy chain with 1086 ($Å^2$), as compared with 256 ($Å^2$) originating from the light chain, with 829 ($Å^2$) coming from the CDRH3 alone, which is 62% of the total buried surface (1342 ($Å^2$)). The CRLR polypeptide appears to be the main target for the 4E4 Fab with 1013 ($Å^2$) as all CDRs, except for CDRH1, buried into this region. In contrast, only CDRH1, CDRH2, and CDRH3 of the 4E4 Fab buried into the RAMP1 polypeptide for a total of 329 ($Å^2$) buried surface into RAMP1.

All amino acids in the CGRP receptor that contained at least one non-hydrogen atom at a distance of 5.0 Å or less from a non-hydrogen atom in the 4E4 Fab were determined to be the core interface amino acids in the ECD of the CGRP receptor. Distances of the atoms were calculated with the PyMOL Molecular Graphics System, Version 2.1.1 (Schrödinger, LLC; DeLano, W. L. The PyMOL Molecular Graphics System. (Palo Alto, 2002)). The core interface amino acids in the CGRP receptor included E23, L24, E25, E26, E29, R38, I41, M42, D70, G71, W72, F92, D94, F95, K103, H114, A116, S117, R119, T120, W121, T122, Y124, N128, T131, H132, and E133 in the CRLR polypeptide (amino acid positions relative to SEQ ID NO: 1) and R67, A70, D71, W74, E78, C82, F83, W84, and P85 in the RAMP1 polypeptide (amino acid positions relative to SEQ ID NO: 2). See Table 18. Amino acid residues in the heavy and light chain variable regions of the 4E4 Fab fragment that were within 5 Å distance or less from the CGRP receptor were also determined. These amino acids included S26, S27, G30, N31, N32, Y33, D51, N52, K67, S94, and R95 in the light chain variable region (amino acid positions relative to SEQ ID NO: 23) and T28, S31, F53, D54, G55, S56, L101, N102, Y103, Y104, D105, S106, S107, G108, Y109, Y110, H111, K113, and Y115 in the heavy chain variable region (amino acid positions relative to SEQ ID NO: 47). See Table 18.

TABLE 18

4E4 Fab/CGRP Receptor Interface Amino Acids within 5.0 Å

| 4E4 Fab HC Amino Acids[1] | 4E4 Fab LC Amino Acids[2] | CRLR Polypeptide Amino Acids[3] | RAMP1 Polypeptide Amino Acids[4] | Distances (Å) |
|---|---|---|---|---|
| T28 | | | E78 | 3.71-4.86 |
| S31 | | | W74 | 3.91-4.96 |
| S31 | | | E78 | 2.83-4.98 |
| F53 | | | F83 | 4.24-4.92 |
| F53 | | R119 | | 3.57-4.88 |
| D54 | | | F83 | 4.08-4.86 |
| D54 | | A116 | | 4.39-4.76 |
| D54 | | S117 | | 2.87-4.96 |
| D54 | | R119 | | 2.80-4.85 |
| G55 | | H114 | | 4.79 |
| G55 | | A116 | | 3.29-4.77 |
| S56 | | H114 | | 3.36-4.95 |
| S56 | | A116 | | 4.29-4.99 |
| S56 | | S117 | | 4.65 |
| S56 | | R119 | | 3.62-4.95 |
| S56 | | W121 | | 4.37-4.58 |
| L101 | | E23 | | 4.62 |
| N102 | | | W74 | 4.53 |
| N102 | | | W74 | 3.96-4.97 |
| N102 | | | E78 | 4.31 |
| Y103 | | | W74 | 3.29-4.98 |
| Y103 | | | C82 | 4.11-4.89 |
| Y103 | | | F83 | 3.76-4.91 |
| Y103 | | | W84 | 3.21-4.99 |
| Y104 | | | R67 | 4.75 |
| Y104 | | | A70 | 3.26-4.42 |
| Y104 | | | D71 | 2.78-4.93 |
| Y104 | | | W74 | 3.34-4.98 |
| Y104 | | | W74 | 3.36-5.00 |
| Y104 | | | W84 | 3.77-4.96 |
| Y104 | | R38 | | 3.17-4.89 |
| Y104 | | M42 | | 4.50 |

TABLE 18-continued

4E4 Fab/CGRP Receptor Interface Amino Acids within 5.0 Å

| 4E4 Fab HC Amino Acids[1] | 4E4 Fab LC Amino Acids[2] | CRLR Polypeptide Amino Acids[3] | RAMP1 Polypeptide Amino Acids[4] | Distances (Å) |
|---|---|---|---|---|
| D105 | | | W74 | 4.55 |
| D105 | | E23 | | 3.40-4.99 |
| D105 | | L24 | | 3.25-4.75 |
| D105 | | R38 | | 4.18-4.93 |
| S106 | | L24 | | 3.63-4.92 |
| S106 | | F92 | | 4.88 |
| S107 | | L24 | | 3.87-4.94 |
| S107 | | R38 | | 4.62-4.73 |
| S107 | | I41 | | 3.18-4.74 |
| S107 | | G71 | | 4.57-4.85 |
| S107 | | W72 | | 3.08-4.85 |
| S107 | | F92 | | 4.23-4.69 |
| G108 | | W72 | | 4.45-4.94 |
| Y109 | | | W84 | 3.30-4.92 |
| Y109 | | | P85 | 4.02-4.97 |
| Y109 | | D70 | | 4.50-4.93 |
| Y109 | | G71 | | 3.92-4.99 |
| Y109 | | W72 | | 3.77-4.98 |
| Y109 | | R119 | | 2.92-4.90 |
| Y110 | | D70 | | 2.99-4.98 |
| Y110 | | G71 | | 4.98 |
| Y110 | | W72 | | 3.65-4.90 |
| Y110 | | K103 | | 4.93 |
| Y110 | | R119 | | 3.35-4.99 |
| Y110 | | T120 | | 3.23-4.88 |
| Y110 | | W121 | | 3.91-4.90 |
| Y110 | | T122 | | 3.64-4.94 |
| Y110 | | Y124 | | 3.39-4.99 |
| H111 | | W72 | | 3.36-4.97 |
| H111 | | F92 | | 3.79-4.99 |
| H111 | | F95 | | 4.47-4.74 |
| H111 | | N128 | | 4.24-4.76 |
| K113 | | L24 | | 3.98-4.82 |
| K113 | | E25 | | 4.06-4.70 |
| K113 | | F92 | | 4.31-4.74 |
| K113 | | D94 | | 3.51-4.66 |
| Y115 | | E23 | | 4.20-4.57 |
| Y115 | | L24 | | 2.41-4.83 |
| Y115 | | E25 | | 4.34-4.95 |
| Y115 | | F92 | | 4.64 |
| | S26 | H132 | | 4.84 |
| | S26 | E133 | | 4.02-5.00 |
| | S27 | H132 | | 4.64-4.72 |
| | G30 | E26 | | 4.81 |
| | N31 | E26 | | 3.67-5.00 |
| | N31 | H132 | | 4.99 |
| | N31 | E133 | | 3.38-4.96 |
| | N32 | E26 | | 3.67-4.97 |
| | Y33 | E23 | | 4.81-4.94 |
| | Y33 | L24 | | 4.98 |
| | Y33 | E25 | | 3.40-4.94 |
| | Y33 | E26 | | 3.10-5.00 |
| | D51 | E23 | | 4.36 |
| | N52 | E26 | | 3.42-4.92 |
| | K67 | E26 | | 2.76-4.99 |
| | K67 | E29 | | 4.91 |
| | S94 | T131 | | 2.82-4.95 |
| | R95 | T131 | | 3.19-4.96 |
| | R95 | H132 | | 3.53-4.94 |

[1]Amino acid positions with reference to SEQ ID NO: 47
[2]Amino acid positions with reference to SEQ ID NO: 23
[3]Amino acid positions with reference to SEQ ID NO: 1
[4]Amino acid positions with reference to SEQ ID NO: 2

Closer inspection the CGRP receptor/4E4 Fab complex interface allowed for the identification of all the amino acid residues in the Fab fragment that were within 3.5 Å distance or less from the CGRP receptor. See Table 19 below. Analysis of the 4E4 Fab heavy chain shows 13 amino acid residues making contacts with amino acids on the receptor (S31, D54, G55, S56, Y103, Y104, D105, S107, Y109, Y110, H111, K113 and Y115; amino acid positions with reference to SEQ ID NO: 47). Specifically, S31 in CDRH1, G55 and S56 in CDRH2, and H111, K113, and Y115 in CDRH3 each interact with a single amino acid residue in the CGRP receptor, whereas D54 in CDRH2 and Y103, D105, S107, and Y110 in CDRH3 interact with two or more amino acids in the CRLR or RAMP1 polypeptides (Table 19). Amino acids Y104 and Y109 in CDRH3 make multiple contacts with amino acid residues from both CRLR and RAMP1 polypeptides simultaneously (Table 19). Analysis of the 4E4 Fab light chain shows 6 amino residues (N31, Y33, N52, K67, S94, and R95; amino acid positions with reference to SEQ ID NO: 23) establishing contacts with the CRLR polypeptide subunit, but not the RAMP1 polypeptide subunit. In particular, Y33 in CDRL1 contacts 2 amino acids in the CRLR polypeptide, whereas N31 in CDRL1, N52 in CDRL2, K67 in framework 3, and S94 and R95 in CDRL3 each contact a single amino acid in the CRLR polypeptide (Table 19).

TABLE 19

4E4 Fab/CGRP Receptor Interface Amino Acids within 3.5 Å

| 4E4 Fab HC Amino Acids[1] | 4E4 Fab LC Amino Acids[2] | CRLR Polypeptide Amino Acids[3] | RAMP1 Polypeptide Amino Acids[4] | Nature of Interaction[5] |
|---|---|---|---|---|
| S31 | | | E78 | Sidechain OH of S31 hydrogen bond (H-bond) 2.8 Å to sidechain E78 OE1 |
| D54 | | S117 | | Sidechain OD2 of D54 H-bond 2.9 Å to sidechain S117 OH |
| D54 | | R119 | | Sidechain OD2 of D54 H-bond to sidechain R119 NE 2.8 Å, NH2 3.2 Å |
| G55 | | A116 | | Backbone O of G55 3.3 Å to sidechain A116 CB |

TABLE 19-continued

4E4 Fab/CGRP Receptor Interface Amino Acids within 3.5 Å

| 4E4 Fab HC Amino Acids[1] | 4E4 Fab LC Amino Acids[2] | CRLR Polypeptide Amino Acids[3] | RAMP1 Polypeptide Amino Acids[4] | Nature of Interaction[5] |
|---|---|---|---|---|
| S56 | | H114 | | Backbone CA of S56 3.4 Å to sidechain H114 CE1, sidechain CB of S56 3.4 Å to sidechain H114 ND1 |
| Y103 | | | W74 | Sidechain OH of Y103 3.3 Å to sidechain W74 CZ3 |
| Y103 | | | W84 | Sidechain CE2 of Y103 3.5 Å to backbone W84 O |
| Y103 | | | W84 | Sidechain OH of Y103 3.2 Å to backbone N |
| Y104 | | R38 | | Sidechain OH of Y104 3.2 Å to sidechain R38 NH1 |
| Y104 | | | A70 | Sidechain OH of Y104 3.3 Å to backbone A70 C, O |
| Y104 | | | D71 | Sidechain OH of Y104 H-bond 2.8 Å to sidechain D71 OD1 |
| Y104 | | | W74 | Sidechain of Y104 3.3-3.5 Å face-to-face π stacking to sidechain W74 |
| D105 | | E23 | | Backbone O of D105 3.4 Å to sidechain E23 OE2 |
| D105 | | L24 | | Backbone O of D105 3.2 Å to sidechain L24 CD2 |
| S107 | | I41 | | Sidechain OH of S107 3.2 Å to sidechain I41 CD1 |
| S107 | | W72 | | Backbone O of S107 H-bond 3.1 Å to sidechain W72 NE1 and 3.3 Å CZ2, sidechain OH of S107 3.3 Å to sidechain W72 NE1 |
| Y109 | | R119 | | Backbone O of Y109 H-bond 3.1 Å to sidechain R119 NH1 and 2.9 Å NH2 |
| Y109 | | | W84 | Sidechain OH of Y109 3.3 Å to sidechain W84 CZ3 and 3.4 Å to CE3, sidechain CE1 of Y109 3.3 Å to backbone W84 O |
| Y110 | | D70 | | Sidechain OH of Y110 H-bond 3.0 Å to backbone D70 O |
| Y110 | | Y124 | | Sidechain CB of Y110 3.5 Å to sidechain Y124 CD1, sidechain CD2 of Y110 3.4 Å to sidechain Y124 CE1 |
| Y110 | | T120 | | Sidechain OH of Y110 H-bond 3.2 Å to backbone T120 O |
| Y110 | | R119 | | Sidechain CE1 of Y110 3.5 Å to sidechain R119 NH1 |
| H111 | | W72 | | Sidechain CD2 of H111 3.4 Å to sidechain W72 CH2 |
| K113 | | D94 | | Sidechain NZ of K113 3.5 Å to sidechain D94 OD2 |
| Y115 | | L24 | | Sidechain OH of Y115 H-bond 2.4 Å to backbone L24 O |
| | N31 | E133 | | Sidechain OD1 of N31 3.4 Å to sidechain E133 CG |
| | Y33 | E25 | | Sidechain OH of Y33 3.4 Å to backbone E25 O |
| | Y33 | E26 | | Sidechain CE1 of Y33 3.1 Å to sidechain E26 OE2 |
| | N52 | E26 | | Sidechain ND2 of N52 3.4 Å to sidechain E26 OE1 |
| | K67 | E26 | | Sidechain NZ of K67 H-bond 2.8 Å to sidechain E26 OE1 |

TABLE 19-continued

| 4E4 Fab/CGRP Receptor Interface Amino Acids within 3.5 Å | | | | |
|---|---|---|---|---|
| 4E4 Fab HC Amino Acids[1] | 4E4 Fab LC Amino Acids[2] | CRLR Polypeptide Amino Acids[3] | RAMP1 Polypeptide Amino Acids[4] | Nature of Interaction[5] |
| | S94 | T131 | | Backbone O of S94 H-bond 2.8 Å to sidechain T131 OG1 |
| | R95 | H132 | | Sidechain CZ of R95 3.5 Å face-to-face π stacking to sidechain H132 CE1 |

[1]Amino acid positions with reference to SEQ ID NO: 47
[2]Amino acid positions with reference to SEQ ID NO: 23
[3]Amino acid positions with reference to SEQ ID NO: 1
[4]Amino acid positions with reference to SEQ ID NO: 2
[5]Atom positions within the amino acids are defined using the Protein Data Bank (PDB) format for atomic coordinates Based on this detailed structural information, amino acid residues D54, Y103, Y104, Y109, Y110, and K113 in the heavy chain and Y33, K67, and R95 in the light chain were selected for substitution with alanine to generate single-point alanine mutation variants. The alanine mutation variants were generated using site-directed mutagenesis and recombinantly expressed as monoclonal antibodies using methods similar to those described in Example 1 above. The impact of the alanine substitutions at each of the nine amino acid residues in the 4E4 variable regions on the inhibitory potency of the antibody was evaluated using the cell-based cAMP assay described in Example 1 above. The results are shown in FIGS. 8A-8C.

Figure 8A:
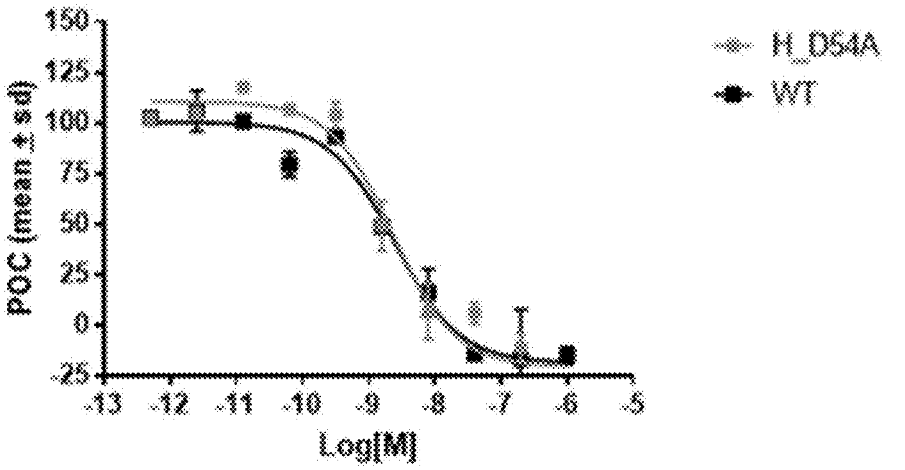
FIGS. 8A-8C depict dose-response curves for wild-type 4E4 anti-CGRP receptor monoclonal antibody (WT) and single-point alanine mutation variant antibodies for inhibition of CGRP-induced activation of the human CGRP receptor. Percent of control (POC), in which control is defined as the activity of the CGRP agonist in the assay, is plotted versus log concentration of the antibodies.
Figure 8B:
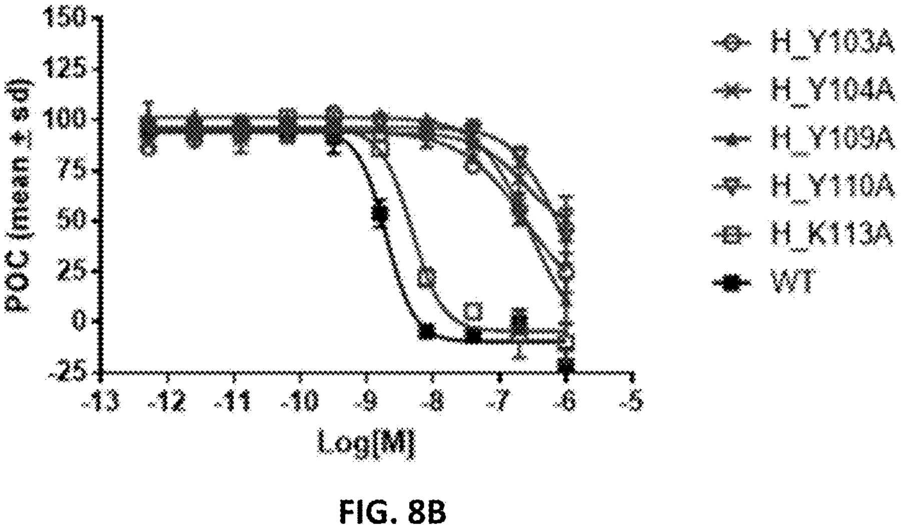
Figure 8C:
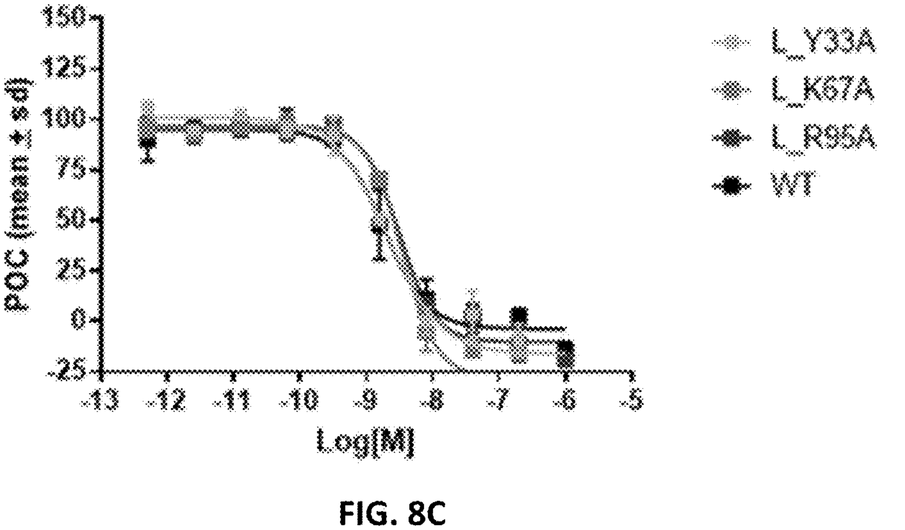
Figure 9:
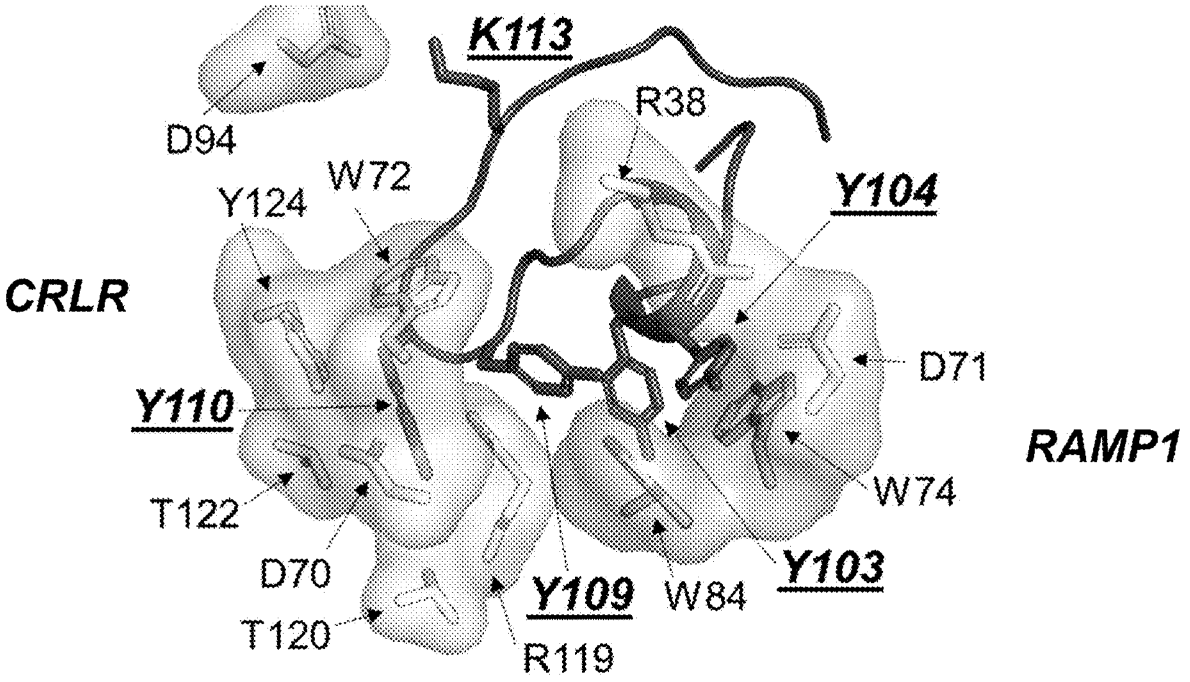
FIG. 9 is a representation of the interaction between selected amino acids in the CDRH3 of the 4E4 Fab and the CRLR and RAMP1 polypeptide subunits of the CGRP receptor. Amino acids in the CDRH3 of the Fab are depicted in ball and stick format, whereas amino acids in the CRLR and RAMP1 polypeptides are depicted in ball and stick format within the molecular surface.

Surprisingly, only the 4E4 variants having alanine mutations in the CDRH3 region exhibited reduced potency as compared to the wild-type antibody (FIGS. 8A-8C). The structural cluster of four tyrosine residues Y103, Y104, Y109 and Y110, which sit deep in the interface of the CRLR/RAMP1 heterodimer (FIG. 9), make multiple hydrophobic contacts through their side-chains staked against amino acid W72 in the CRLR polypeptide and amino acids W74 and W84 in the RAMP1 polypeptide (FIG. 9). The results of the activity assay show a reduction in potency for the Y103A, Y104A, Y109A and Y110A single-point alanine mutants when compared against the wild-type antibody, suggesting these tyrosine residues and their interaction with the CRLR/RAMP1 interface is important for the inhibitory activity of the antibody (FIG. 8B). Amino acid residue K113 in the CDRH3, which makes a H-bond with amino acid D94 in the CRLR polypeptide (FIG. 9 and Table 19), also appeared to play a role in the inhibitory function of the antibody as introduction of an alanine amino acid at this position reduced the inhibitory potency of the antibody, though to a lesser extent than substitution at the tyrosine amino acids (FIG. 8B). In contrast, amino acid D54 in CDRH2 of the Fab, which establishes H-bond contacts with amino acid R119 in the CRLR polypeptide, does not appear to play a critical role in the ability of the antibody to inhibit the CGRP receptor as substitution of alanine at this position did not significantly affect the potency of the antibody (FIG. 8A). Similarly, alanine substitutions at Y33 in CDRL1, K67A in framework 3 in the light chain, and R95A in CDRL3 did not significantly impact the inhibitory activity of the antibody (FIG. 8C).

Figure 10A:
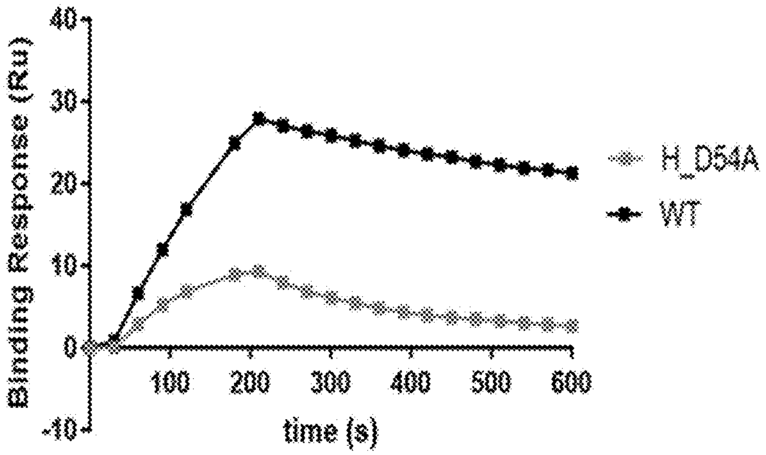
FIGS. 10A-10C show binding profiles of soluble CGRP receptor to wild-type 4E4 anti-CGRP receptor monoclonal antibody (WT) and single-point alanine mutation variant antibodies by surface plasmon resonance.

The same nine single-point alanine variants were also evaluated in a CGRP receptor binding assay using surface plasmon resonance (SPR) to ascertain the effect of the mutations on binding affinity and binding kinetics of the antibody for the receptor. The kinetics of binding of the wild-type antibody and the single-point alanine mutants to the soluble human CGRP receptor were determined by SPR using a Biacore® T-200 optical biosensor (GE Healthcare) and a SCM5 sensor chip (GE Healthcare). Antibody samples were captured to the Biacore® chip surface using a goat-anti-human Fc antibody (Jackson ImmunoResearch Laboratories, Inc., West Grove, PA, USA). The dissociation equilibrium binding constant ($K_D$) for the antibodies binding to the CGRP receptor were calculated by determination of kinetic rate constants in binding analysis experiments. Eleven concentrations of soluble CGRP receptor (analyte) ranging between 1000 nM and 0.98 nM were run against captured anti-CGRP receptor antibodies on a SCM5 surface. Blank (buffer) injections were run simultaneously with the eleven analyte concentrations and used to assess and subtract system artifacts. Using the Biacore® T200 evaluation software 3.0 (GE Healthcare), the data were aligned, double referenced, and analyzed by global fitting to a 1:1 binding model to obtain the respective association rate constant ($k_a$) and dissociation rate constant ($k_d$) values. Equilibrium dissociation constant ($K_D$) was then calculated as $k_d$ divided by $k_a$. The binding profiles are shown in FIGS. 10A-10C and the rate constants are summarized in Table 20 below.

TABLE 20

| Binding Kinetics of Anti-CGRP Receptor Antibodies to Soluble CGRP Receptor | | | | |
|---|---|---|---|---|
| Antibody Sample | $k_a$ ($M^{-1}s^{-1}$) | $k_d$ ($s^{-1}$) | $K_D$ (M) | Rmax (response units) |
| Wild-type | 2.0E+04 | 5.4E−04 | 2.8E−08 | 139.2 |
| Heavy chain alanine variants | | | | |
| D54A | 1.5E+04 | 2.6E−03 | 1.8E−07 | 84.7 |
| Y103A | | No Binding | | |
| Y104A | | | | |
| Y109A | | | | |
| Y110A | | | | |
| K113A | 1.8E+04 | 6.0E−04 | 3.3E−08 | 114.8 |
| Light chain alanine variants | | | | |
| Y33A | 2.4E+04 | 2.7E−04 | 1.1E−08 | 141.5 |
| K67A | 1.6E+04 | 4.6E−04 | 2.9E−08 | 115.9 |
| R95A | 1.8E+04 | 7.7E−04 | 4.3E−08 | 118.4 |

Figure 10B:
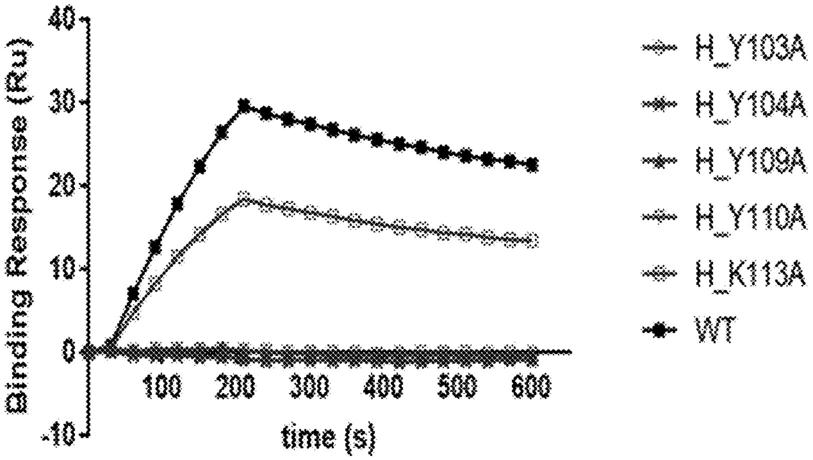
Figure 10C:
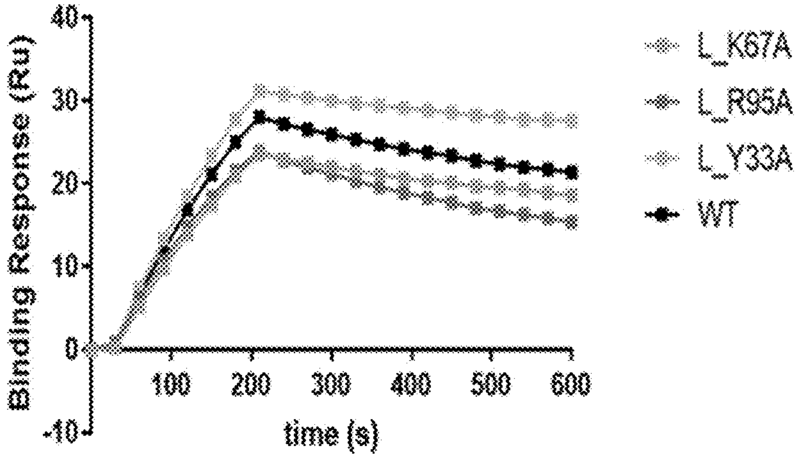

The CDRH3 variants Y103A, Y104A, Y109A and Y110A lost their ability to bind to the CGRP receptor (FIG. 10B). The K113A variant retained its ability to bind to the receptor, but with reduced affinity as compared to the wild-type antibody (FIG. 10B; Table 20). The D54A mutation in CDRH2 produced a decrease in binding affinity, mainly due to ~5× faster dissociation rate when compared with wild-type (FIG. 10A and Table 20). However, this decreased binding affinity did not appear to significantly affect the inhibitory potency of this variant antibody as shown in FIG. 8A and discussed above. Interestingly, light chain variants Y33A (CDRL1) and R95A (CDRL3) exhibited a slight increase and a slight decrease in binding affinity, respectively, when compared with the wild-type antibody, whereas the K67A mutation in the framework 3 region did not significantly alter the binding affinity (FIG. 10C and Table 20). The results highlight the importance of the CDRH3, particularly tyrosine residues Y103, Y104, Y109, and Y110, in brokering the binding interaction between the 4E4 antibody and the CGRP receptor.

As indicated by the crystal structure (e.g. FIGS. 7A and 7B) and further confirmed by the functional assay (e.g. FIG. 8B), the inhibitory potency of the 4E4 antibody is largely mediated by its long CDRH3 region. The CDRH3 region comprises a hydrophobic cluster of four tyrosine residues (Y103, Y104, Y109, and Y110) at the tip with their side-chains projecting out and a short helix-turn between Y104 and Y109 residues (FIG. 9). Given that the single-point alanine mutations in the CDRH3 greatly reduced the binding affinity and inhibitory activity of the antibody (FIGS. 8B and 10B), the structure of the CDRH3 was investigated in more detail. Eight intramolecular contacts within 3.5 Å or less between the side-chains of Y103, Y104, Y109 and Y110 or between the side-chains and the main-chain of the same residues were identified. Thus, the substitution of any of these four tyrosine residues by an alanine residue is likely to disrupt this network of contacts resulting in a loss of structural stability of the CDRH3 and consequently, function of the antibody.

Figure 11:
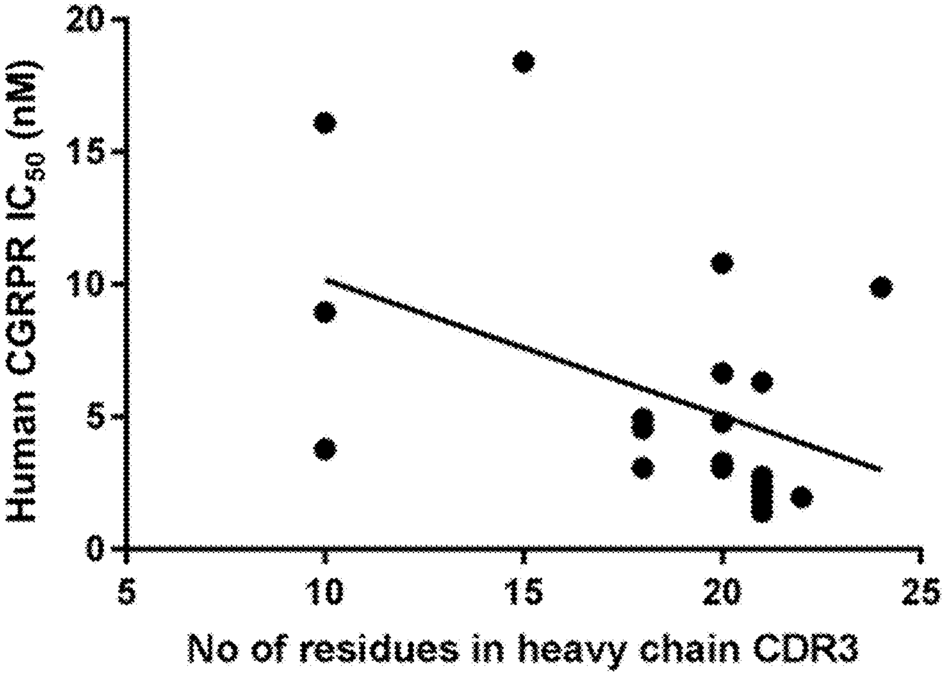
FIG. 11 is a graph showing the correlation between in vitro potency (IC50) for anti-CGRP receptor antibodies inhibiting human CGRP receptor activation as measured by a cell-based cAMP assay and the number of amino acids in CDR3 of the heavy chain variable region of the antibodies.

To further examine the features of the CDRH3 important for the function of anti-CGRP receptor antibodies, amino acid sequences of the CDRH3 region for a panel of 21 different anti-CGRP receptor antibodies were aligned and analyzed in view of the in vitro potency of the antibodies as measured by the cell-based cAMP assay described in Example 1. There was a direct correlation between the length of the CDRH3 and potency of the antibodies with greater potencies (lower IC50 values) observed for antibodies having more amino acids in the CDRH3 (FIG. 11). As shown in Table 21 below, the potency of the antibodies also correlated with the specific amino acid present at positions corresponding to positions 103, 104, 109 and 110 in SEQ ID NO: 47. In most cases, tyrosine was the amino acid that was most frequently present at these four positions in antibodies exhibiting greater inhibitory potency (i.e. lower IC50 values). Taken together, the results suggest that anti-CGRP receptor antibodies that have a CDRH3 region with at least 18 amino acids and tyrosine residues at positions corresponding to positions 103, 104, 109, and 110 of SEQ ID NO: 47 should maintain the conformational stability of the CDRH3 necessary to interact with the CRLR/RAMP1 ECD heterodimer and thereby potently inhibit activation of the CGRP receptor.

TABLE 21

In Vitro Potency of Anti-CGRP Receptor Antibodies with Specific Amino Acids in CDRH3

| | Average Human CGRP Receptor IC50 (nM) | | | |
|---|---|---|---|---|
| Amino Acid | Position 103 | Position 104 | Position 109 | Position 110 |
| Tyrosine (Y) | 1.92 | 1.92 | 4.86 | 4.28 |
| Valine (V) | 6.30 | 7.42 | 9.42 | — |
| Serine (S) | 1.95 | 1.95 | 3.55 | — |
| Threonine (T) | 9.89 | 3.96 | — | — |
| Isoleucine (I) | 10.57 | 2.74 | — | — |
| Arginine (R) | 7.42 | — | 7.22 | — |
| Glycine (G) | — | 6.30 | 8.10 | — |
| Leucine (L) | — | 9.89 | 7.42 | — |
| Phenylalanine (F) | — | 18.4 | — | 2.74 |
| Tryptophan (W) | — | — | — | 7.51 |
| Alanine (A) | — | — | — | 3.08 |
| None[1] | 6.30 | 8.17 | — | — |

[1]Due to shorter length CDRH3, some antibodies did not have amino acids at positions corresponding to positions 103 and 104 in SEQ ID NO: 47.

Next, the paratope-epitope interface between the 4E4 Fab and the CGRP receptor in the crystal structure (e.g. region shown in FIG. 7B) was analyzed to identify amino acid positions within the variable regions of the Fab that could be manipulated to enhance the interactions between the paratope of the antibody and the epitope on the CGRP receptor to improve binding affinity and/or inhibitory potency of the antibody. Specifically, in CDRH1 or adjacent thereto, mutation of Thr28 and Ser31 (amino acid positions with reference to SEQ ID NO: 47 or 48) to asparagine, lysine, arginine, or histidine was proposed to provide better charge complementarity or hydrogen bonding potential to Glu78 in the RAMP1 polypeptide (SEQ ID NO: 2). In CDRH3, which plays an important role in the inhibitory function of the anti-CGRP receptor antibody as discussed above, mutation of Asn102 (amino acid position with reference to SEQ ID NO: 47 or 48) to aspartic acid or glutamic acid was proposed to enhance the interaction with Trp74 in the RAMP1 polypeptide (SEQ ID NO: 2). One or more of these mutations can be incorporated into an anti-CGRP receptor antibody by recombinant production and tested for the ability to inhibit CGRP-induced activation of the human CGRP receptor using, for example, the cell-based cAMP assay described in Example 1.

All publications, patents, and patent applications discussed and cited herein are hereby incorporated by reference in their entireties. It is understood that the disclosed invention is not limited to the particular methodology, protocols and materials described as these can vary. It is also understood that the terminology used herein is for the purposes of describing particular embodiments only and is not intended to limit the scope of the appended claims.

Those skilled in the art will recognize, or be able to ascertain using no more than routine experimentation, many equivalents to the specific embodiments of the invention described herein. Such equivalents are intended to be encompassed by the following claims.

SEQUENCE LISTING (477 sequences)

SEQ ID NO: 1 - protein, 461 aa, Homo sapiens [sequence omitted]

SEQ ID NO: 2 - protein, 148 aa, Homo sapiens
MARALCRLPRRGLWLLLAHHLFMTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 3 - protein, 116 aa, Homo sapiens
ELEESPEDSIQLGVTRNKIMTAQYECYQKIMQDPIQQAEGVYCNRTWDGWLCWNDVAAGTESMQLCPDYFQDFDPSEKVTKICDQDGNWFRHPASNRTWTNYTQCNVNTHEKVKTA

SEQ ID NO: 4 - protein, 91 aa, Homo sapiens
CQEANYGALLRELCLTQFQVDMEAVGETLWCDWGRTIRSYRELADCTWHMAEKLGCFWPNAEVDRFFLAVHGRYFRSCPISGRAVRDPPGS

SEQ ID NO: 5 - protein, 13 aa, Artificial Sequence
  synthetic polypeptide
SGSSSNIGNNYVS

SEQ ID NO: 6 - protein, 13 aa, Artificial Sequence
  synthetic polypeptide
SGSYSNIGRYSVS

SEQ ID NO: 7 - protein, 13 aa, Artificial Sequence
  synthetic polypeptide
SGSRSNIGIKAVS

SEQ ID NO: 8 - protein, 13 aa, Artificial Sequence
  synthetic polypeptide
SGSFSNIGRSTVS

SEQ ID NO: 9 - protein, 13 aa, Artificial Sequence
  synthetic polypeptide
SGSYSNIGRKSVS

SEQ ID NO: 10 - protein, 13 aa, Artificial Sequence
  synthetic polypeptide
SGSYSNIGWWPVS

SEQ ID NO: 11 - protein, 13 aa, Artificial Sequence
  synthetic polypeptide
SGSRSNIGRYSVS

SEQ ID NO: 12 - protein, 13 aa, Artificial Sequence
  synthetic polypeptide
SGSRSNIGRRTVS

SEQ ID NO: 13 - protein, 7 aa, Artificial Sequence
  synthetic polypeptide
DNNKRPS

SEQ ID NO: 14 - protein, 7 aa, Artificial Sequence
  synthetic polypeptide
DNRWRAG

SEQ ID NO: 15 - protein, 7 aa, Artificial Sequence
  synthetic polypeptide
ENMFRPR

SEQ ID NO: 16 - protein, 7 aa, Artificial Sequence
  synthetic polypeptide
DNRYRAQ

SEQ ID NO: 17 - protein, 11 aa, Artificial Sequence
  synthetic polypeptide
GTWDSRLSAVV

SEQ ID NO: 18 - protein, 11 aa, Artificial Sequence
  synthetic polypeptide
GTWDYQWKAVV

SEQ ID NO: 19 - protein, 11 aa, Artificial Sequence
  synthetic polypeptide
GTWDYRMQAVV

SEQ ID NO: 20 - protein, 11 aa, Artificial Sequence
  synthetic polypeptide
GTWDWATTSVV

SEQ ID NO: 21 - protein, 11 aa, Artificial Sequence
  synthetic polypeptide
GTWDSWHRVVT

SEQ ID NO: 22 - protein, 11 aa, Artificial Sequence
  synthetic polypeptide
GTWDWWRKAVI

SEQ ID NO: 23 - protein, 111 aa, Artificial Sequence [sequence omitted]

SEQ ID NO: 24 - protein, 111 aa, Artificial Sequence
  synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVLG

SEQ ID NO: 25 - protein, 111 aa, Artificial Sequence
  synthetic polypeptide
QSVLTQPPSVSAAPGQKVTISCSGSYSNIGRYSVSWYQQLPGTAPKLLIYDNNKRPSGIPDRFSGSKSGTSATLGITGLQTGDEADYYCGTWDSRLSAVVFGGGTKLTVLG

SEQ ID NO: 26 - protein, 111 aa, Artificial Sequence
  synthetic polypeptide
QSVLTQPPSVSAAPGQKVTISCSGSRSNIGIKAVSWYQQLPGTAPKLLIYDNNKRPSGIPDRFSGSKSGTSATLGITGLQTGDEADYYCGTWDSRLSAVVFGGGTKLTVLG

SEQ ID NO: 27 - protein, 111 aa, Artificial Sequence
  synthetic polypeptide
QSVLTQPPSVSAAPGQKVTISCSGSFSNIGRSTVSWYQQLPGTAPKLLIYDNRWRAGGIPDRFSGSKSGTSATLGITGLQTGDEADYYCGTWDYQWKAVVFGGGTKLTVLG

SEQ ID NO: 28 - protein, 111 aa, Artificial Sequence
  synthetic polypeptide
QSVLTQPPSVSAAPGQKVTISCSGSYSNIGRKSVSWYQQLPGTAPKLLIYDNNKRPSGIPDRFSGSKSGTSATLGITGLQTGDEADYYCGTWDSRLSAVVFGGGTKLTVLG

SEQ ID NO: 29 - protein, 111 aa, Artificial Sequence
  synthetic polypeptide
QSVLTQPPSVSAAPGQKVTISCSGSYSNIGWWPVSWYQQLPGTAPKLLIYDNNKRPSGIPDRFSGSKSGTSATLGITGLQTGDEADYYCGTWDSRLSAVVFGGGTKLTVLG

SEQ ID NO: 30 - protein, 111 aa, Artificial Sequence
  synthetic polypeptide
QSVLTQPPSVSAAPGQKVTISCSGSRSNIGRYSVSWYQQLPGTAPKLLIYENMFRPRGIPDRFSGSKSGTSATLGITGLQTGDEADYYCGTWDYRMQAVVFGGGTKLTVLG

SEQ ID NO: 31 - protein, 111 aa, Artificial Sequence
  synthetic polypeptide
QSVLTQPPSVSAAPGQKVTISCSGSRSNIGRYSVSWYQQLPGTAPKLLIYDNRYRAQGIPDRFSGSKSGTSATLGITGLQTGDEADYYCGTWDWATTSVVFGGGTKLTVLG

SEQ ID NO: 32 - protein, 111 aa, Artificial Sequence
  synthetic polypeptide
QSVLTQPPSVSAAPGQKVTISCSGSRSNIGRRTVSWYQQLPGTAPKLLIYDNNKRPSGIPDRFSGSKSGTSATLGITGLQTGDEADYYCGTWDSRLSAVVFGGGTKLTVLG

SEQ ID NO: 33 - protein, 111 aa, Artificial Sequence
  synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSWHRVVTFGGGTKLTVLG

SEQ ID NO: 34 - protein, 111 aa, Artificial Sequence
  synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDWWRKAVIFGGGTKLTVLG

SEQ ID NO: 35 - protein, 5 aa, Artificial Sequence
  synthetic polypeptide
SFGMH

SEQ ID NO: 36 - protein, 5 aa, Artificial Sequence
  synthetic polypeptide
TYGMH

SEQ ID NO: 37 - protein, 5 aa, Artificial Sequence
  synthetic polypeptide
SYGMH

SEQ ID NO: 38 - protein, 5 aa, Artificial Sequence
  synthetic polypeptide
TFGMH

SEQ ID NO: 39 - protein, 17 aa, Artificial Sequence
  synthetic polypeptide
VISFDGSIKYSVDSVKG

SEQ ID NO: 40 - protein, 17 aa, Artificial Sequence
  synthetic polypeptide
VISFAGEIDYYVDSVKG

SEQ ID NO: 41 - protein, 17 aa, Artificial Sequence
  synthetic polypeptide
VISFAGEIEHYVDSVKG

SEQ ID NO: 42 - protein, 17 aa, Artificial Sequence
  synthetic polypeptide
VISFAGEDTHYVDSVKG

SEQ ID NO: 43 - protein, 21 aa, Artificial Sequence
  synthetic polypeptide
DRLNYYDSSGYYHYKYYGMAV

SEQ ID NO: 44 - protein, 21 aa, Artificial Sequence
  synthetic polypeptide
DRLNYYESSGYYHYKYYGMAV

SEQ ID NO: 45 - protein, 21 aa, Artificial Sequence
  synthetic polypeptide
DRLNYYRSFGYYGYHYYGMAV

SEQ ID NO: 46 - protein, 21 aa, Artificial Sequence
  synthetic polypeptide
DRLNYYESYGYYGYHYYGMAV

SEQ ID NO: 47 - protein, 130 aa, Artificial Sequence [sequence omitted]

SEQ ID NO: 48 - protein, 130 aa, Artificial Sequence
  synthetic polypeptide
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSS

SEQ ID NO: 49 - protein, 130 aa, Artificial Sequence
  synthetic polypeptide
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYRSFGYYGYHYYGMAVWGQGTTVTVSS

SEQ ID NO: 50 - protein, 130 aa, Artificial Sequence
  synthetic polypeptide
QVQLVESGGGVVQPGRSLRLSCAASGFYFMTYGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSS

SEQ ID NO: 51 - protein, 130 aa, Artificial Sequence
  synthetic polypeptide
QVQLVESGGGVVQPGRSLRLSCAASGFTFSSFGMHWVRQAPGKGLEWVAVISFAGEIDYYVDSVKGRFTISRDNSKNTLFLQMNSLRAEDTAVYYCARDRLNYYESSGYYHYKYYGMAVWGQGTTVTVSS

SEQ ID NO: 52 - protein, 130 aa, Artificial Sequence
  synthetic polypeptide
QVQLVESGGGVVQPGRSLRLSCAASGFFFGSYGMHWVRQAPGKGLEWVAVISFAGEIEHYVDSVKGRFTISRDNSKNTLFLQMNSLRAEDTAVYYCARDRLNYYESSGYYHYKYYGMAVWGQGTTVTVSS

SEQ ID NO: 53 - protein, 130 aa, Artificial Sequence
  synthetic polypeptide
QVQLVESGGGVVQPGRSLRLSCAASGFWFDTFGMHWVRQAPGKGLEWVAVISFAGEDTHYVDSVKGRFTISRDNSKNTLFLQMNSLRAEDTAVYYCARDRLNYYESYGYYGYHYYGMAVWGQGTTVTVSS

SEQ ID NO: 54 - protein, 106 aa, Artificial Sequence
  synthetic polypeptide
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 55 - protein, 106 aa, Artificial Sequence
  synthetic polypeptide
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 56 - protein, 105 aa, Artificial Sequence
  synthetic polypeptide
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 57 - protein, 106 aa, Artificial Sequence
  synthetic polypeptide
GQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 58 - protein, 106 aa, Artificial Sequence
  synthetic polypeptide
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 59 - protein, 106 aa, Artificial Sequence
  synthetic polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 60 - protein, 107 aa, Artificial Sequence [sequence omitted]

SEQ ID NO: 61 - protein, 330 aa, Artificial Sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 330 aa, Artificial Sequence [sequence omitted]

SEQ ID NO: 63 - protein, 330 aa, Artificial Sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 330 aa, Artificial Sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 330 aa, Artificial Sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 330 aa, Artificial Sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 326 aa, Artificial Sequence
  synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 68 - protein, 327 aa, Artificial Sequence
  synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 69 - protein, 216 aa, Artificial Sequence
  synthetic polypeptide
QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 70 - protein, 216 aa, Artificial Sequence
  synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 71 - protein, 216 aa, Artificial Sequence
  synthetic polypeptide
QSVLTQPPSVSAAPGQKVTISCSGSYSNIGRYSVSWYQQLPGTAPKLLIYDNNKRPSGIPDRFSGSKSGTSATLGITGLQTGDEADYYCGTWDSRLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 72 - protein, 216 aa, Artificial Sequence
  synthetic polypeptide
QSVLTQPPSVSAAPGQKVTISCSGSYSNIGRYSVSWYQQLPGTAPKLLIYDNNKRPSGIPDRFSGSKSGTSATLGITGLQTGDEADYYCGTWDSRLSAVVFGGGTKLTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 73 - protein, 216 aa, Artificial Sequence
  synthetic polypeptide
QSVLTQPPSVSAAPGQKVTISCSGSRSNIGIKAVSWYQQLPGTAPKLLIYDNNKRPSGIPDRFSGSKSGTSATLGITGLQTGDEADYYCGTWDSRLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 74 - protein, 216 aa, Artificial Sequence
  synthetic polypeptide
QSVLTQPPSVSAAPGQKVTISCSGSRSNIGIKAVSWYQQLPGTAPKLLIYDNNKRPSGIPDRFSGSKSGTSATLGITGLQTGDEADYYCGTWDSRLSAVVFGGGTKLTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 75 - protein, 216 aa, Artificial Sequence
  synthetic polypeptide
QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 76 - protein, 216 aa, Artificial Sequence
  synthetic polypeptide
QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 77 - protein, 216 aa, Artificial Sequence
  synthetic polypeptide
QSVLTQPPSVSAAPGQKVTISCSGSFSNIGRSTVSWYQQLPGTAPKLLIYDNRWRAGGIPDRFSGSKSGTSATLGITGLQTGDEADYYCGTWDYQWKAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 78 - protein, 216 aa, Artificial Sequence
  synthetic polypeptide
QSVLTQPPSVSAAPGQKVTISCSGSYSNIGRKSVSWYQQLPGTAPKLLIYDNNKRPSGIPDRFSGSKSGTSATLGITGLQTGDEADYYCGTWDSRLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 79 - protein, 216 aa, Artificial Sequence
  synthetic polypeptide
QSVLTQPPSVSAAPGQKVTISCSGSYSNIGWWPVSWYQQLPGTAPKLLIYDNNKRPSGIPDRFSGSKSGTSATLGITGLQTGDEADYYCGTWDSRLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 80 - protein, 216 aa, Artificial Sequence
  synthetic polypeptide
QSVLTQPPSVSAAPGQKVTISCSGSRSNIGRYSVSWYQQLPGTAPKLLIYENMFRPRGIPDRFSGSKSGTSATLGITGLQTGDEADYYCGTWDYRMQAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 81 - protein, 216 aa, Artificial Sequence
  synthetic polypeptide
QSVLTQPPSVSAAPGQKVTISCSGSRSNIGRYSVSWYQQLPGTAPKLLIYDNRYRAQGIPDRFSGSKSGTSATLGITGLQTGDEADYYCGTWDWATTSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 82 - protein, 216 aa, Artificial Sequence
  synthetic polypeptide
QSVLTQPPSVSAAPGQKVTISCSGSRSNIGRRTVSWYQQLPGTAPKLLIYDNNKRPSGIPDRFSGSKSGTSATLGITGLQTGDEADYYCGTWDSRLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 83 - protein, 216 aa, Artificial Sequence
  synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSWHRVVTFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 84 - protein, 216 aa, Artificial Sequence
  synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDWWRKAVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 85 - protein, 456 aa, Artificial Sequence
  synthetic polypeptide
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 86 - protein, 460 aa, Artificial Sequence
  synthetic polypeptide
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 460 aa, Artificial Sequence
  synthetic polypeptide
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 88 - protein, 460 aa, Artificial Sequence
  synthetic polypeptide
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 89 - protein, 460 aa, Artificial Sequence
  synthetic polypeptide
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 90 - protein, 460 aa, Artificial Sequence
  synthetic polypeptide
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 91 - protein, 460 aa, Artificial Sequence
  synthetic polypeptide
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 92 - protein, 460 aa, Artificial Sequence
  synthetic polypeptide
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYRSFGYYGYHYYGMAVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 460 aa, Artificial Sequence
  synthetic polypeptide
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYRSFGYYGYHYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 94 - protein, 460 aa, Artificial Sequence
  synthetic polypeptide
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYRSFGYYGYHYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 95 - protein, 460 aa, Artificial Sequence
  synthetic polypeptide
QVQLVESGGGVVQPGRSLRLSCAASGFYFMTYGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 460 aa, Artificial Sequence
  synthetic polypeptide
QVQLVESGGGVVQPGRSLRLSCAASGFTFSSFGMHWVRQAPGKGLEWVAVISFAGEIDYYVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 460 aa, Artificial Sequence
  synthetic polypeptide
QVQLVESGGGVVQPGRSLRLSCAASGFFFGSYGMHWVRQAPGKGLEWVAVISFAGEIEHYVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 460 aa, Artificial Sequence
  synthetic polypeptide
QVQLVESGGGVVQPGRSLRLSCAASGFWFDTFGMHWVRQAPGKGLEWVAVISFAGEDTHYVDSVKGRFTISRDNSKNTLFLQMNSLRAEDTAVYYCARDRLNYYESYGYYGYHYYGMAVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - DNA, 648 bp, Artificial Sequence
  synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 100 - DNA, 648 bp, Artificial Sequence
  synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 101 - DNA, 648 bp, Artificial Sequence
  synthetic polynucleotide
cagtctgtgttgacgcagccgccctcagtgtctgcggccccaggacagaaggtcaccatctcctgctctggaagctactccaacattgggcgttactctgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 102 - DNA, 648 bp, Artificial Sequence
  synthetic polynucleotide
cagtctgtgttgacgcagccgccctcagtgtctgcggccccaggacagaaggtcaccatctcctgctctggaagctactccaacattgggcgttactctgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccaagagctatctgagcctgacgcctgagcagtggaagtcccacagaagctacagctgccaggtcacgcatgaagggagcaccgtggagaagacagtggcccctacagaatgttca

SEQ ID NO: 103 - DNA, 648 bp, Artificial Sequence
  synthetic polynucleotide
cagtctgtgttgacgcagccgccctcagtgtctgcggccccaggacagaaggtcaccatctcctgctctggaagccgttccaacattgggatcaaagctgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 104 - DNA, 648 bp, Artificial Sequence
  synthetic polynucleotide
cagtctgtgttgacgcagccgccctcagtgtctgcggccccaggacagaaggtcaccatctcctgctctggaagccgttccaacattgggatcaaagctgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccaagagctatctgagcctgacgcctgagcagtggaagtcccacagaagctacagctgccaggtcacgcatgaagggagcaccgtggagaagacagtggcccctacagaatgttca

SEQ ID NO: 105 - DNA, 648 bp, Artificial Sequence
  synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 106 - DNA, 648 bp, Artificial Sequence
  synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccaagagctatctgagcctgacgcctgagcagtggaagtcccacagaagctacagctgccaggtcacgcatgaagggagcaccgtggagaagacagtggcccctacagaatgttca

SEQ ID NO: 107 - DNA, 648 bp, Artificial Sequence
  synthetic polynucleotide
cagtctgtgttgacgcagccgccctcagtgtctgcggccccaggacagaaggtcaccatctcctgctctggaagcttctccaacattgggcgttctactgtatcctggtaccagcagctcccaggaacagcccccaaactcctcatttatgacaatcgttggcgcgcgggtgggattcctgaccgattctctggctccaagtctggcacgtcagccaccctgggcatcaccggactccagactggggacgaggccgattattactgcggaacatgggattaccagtggaaagctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 108 - DNA, 648 bp, Artificial Sequence
  synthetic polynucleotide
cagtctgtgttgacgcagccgccctcagtgtctgcggccccaggacagaaggtcaccatctcctgctctggaagctactccaacattgggcgtaaatctgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 109 - DNA, 648 bp, Artificial Sequence
  synthetic polynucleotide
cagtctgtgttgacgcagccgccctcagtgtctgcggccccaggacagaaggtcaccatctcctgctctggaagctactccaacattgggtggtggccggtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 110 - DNA, 648 bp, Artificial Sequence
  synthetic polynucleotide
cagtctgtgttgacgcagccgccctcagtgtctgcggccccaggacagaaggtcaccatctcctgctctggaagccgttccaacattgggcgttactctgtatcctggtaccagcagctcccaggaacagcccccaaactcctcatttatgaaaatatgttccgcccgcgtgggattcctgaccgattctctggctccaagtctggcacgtcagccaccctgggcatcaccggactccagactggggacgaggccgattattactgcggaacatgggattaccgtatgcaggctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 111 - DNA, 648 bp, Artificial Sequence
  synthetic polynucleotide
cagtctgtgttgacgcagccgccctcagtgtctgcggccccaggacagaaggtcaccatctcctgctctggaagccgttccaacattgggcgttactctgtatcctggtaccagcagctcccaggaacagcccccaaactcctcatttatgacaatcgttaccgcgcgcaggggattcctgaccgattctctggctccaagtctggcacgtcagccaccctgggcatcaccggactccagactggggacgaggccgattattactgcggaacatgggattgggctactacttctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 112 - DNA, 648 bp, Artificial Sequence
  synthetic polynucleotide
cagtctgtgttgacgcagccgccctcagtgtctgcggccccaggacagaaggtcaccatctcctgctctggaagccgttccaacattgggcgtcgtactgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 113 - DNA, 648 bp, Artificial Sequence
  synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggattcttggcatcgtgttgtgactttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 114 - DNA, 648 bp, Artificial Sequence
  synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggattggtggcgtaaagctgtgattttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 115 - DNA, 1368 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 116 - DNA, 1380 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 117 - DNA, 1380 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatctcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 118 - DNA, 1380 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatctcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 119 - DNA, 1380 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatctcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 120 - DNA, 1380 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatctcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctatatcacccgggagcctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 121 - DNA, 1380 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatctcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctatatcacccgggagcctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 122 - DNA, 1380 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaactactatcgtagtttcggttattatggttaccattactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 123 - DNA, 1380 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatctcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaactactatcgtagtttcggttattatggttaccattactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 124 - DNA, 1380 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatctcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaactactatcgtagtttcggttattatggttaccattactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 125 - DNA, 1380 bp, Artificial Sequence
  synthetic polynucleotide
caggtgcagctggtggaatctgggggaggcgtggtccagcctgggaggtccctgagactctcctgtgcagcctctggattctacttcatgacttatggtatgcactgggtccgccaggctccaggcaaggggctggagtgggtggcagttatatcatttgatgggagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 126 - DNA, 1380 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgctggagaaatcgactactacgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 127 - DNA, 1380 bp, Artificial Sequence
  synthetic polynucleotide
caggtgcagctggtggaatctgggggaggcgtggtccagcctgggaggtccctgagactctcctgtgcagcctctggattcttcttcggttcttatggtatgcactgggtccgccaggctccaggcaaggggctggagtgggtggcagttatatcatttgctggagaaatcgaacattacgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 128 - DNA, 1380 bp, Artificial Sequence
  synthetic polynucleotide
caggtgcagctggtggaatctgggggaggcgtggtccagcctgggaggtccctgagactctcctgtgcagcctctggattctggttcgacacttttggtatgcactgggtccgccaggctccaggcaaggggctggagtgggtggcagttatatcatttgctggagaagacactcattacgtagactccgtgaagggccgattcaccatctccagagacaattcaaagaacacgctgtttctgcaaatgaacagcctgcgagccgaggacacggctgtgtattactgtgcgagagatcggctcaactactatgaaagttacggttattatggttaccattactacggtatggccgtctggggccaagggacaacagttaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 129 - protein, 468 aa, Homo sapiens
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 130 - protein, 11 aa, Artificial Sequence
  synthetic polypeptide
RASQSIGRSLH

SEQ ID NO: 131 - protein, 11 aa, Artificial Sequence
  synthetic polypeptide
RASKSVGRSLH

SEQ ID NO: 132 - protein, 11 aa, Artificial Sequence
  synthetic polypeptide
RASKSVGWSLH

SEQ ID NO: 133 - protein, 11 aa, Artificial Sequence
  synthetic polypeptide
RASKSVGYSLH

SEQ ID NO: 134 - protein, 11 aa, Artificial Sequence
  synthetic polypeptide
RASKAVGWSLH

SEQ ID NO: 135 - protein, 11 aa, Artificial Sequence
  synthetic polypeptide
RASKSVGQSLH

SEQ ID NO: 136 - protein, 11 aa, Artificial Sequence
  synthetic polypeptide
RASRSVGLALH

SEQ ID NO: 137 - protein, 11 aa, Artificial Sequence
  synthetic polypeptide
RASKAVGFSLH

SEQ ID NO: 138 - protein, 10 aa, Artificial Sequence
  synthetic polypeptide
RASRAVSNLH

SEQ ID NO: 139 - protein, 11 aa, Artificial Sequence
  synthetic polypeptide
RASKAVWHNLH

SEQ ID NO: 140 - protein, 11 aa, Artificial Sequence
  synthetic polypeptide
RASQSVGRSLH

SEQ ID NO: 141 - protein, 7 aa, Artificial Sequence
  synthetic polypeptide
YASQSLS

SEQ ID NO: 142 - protein, 9 aa, Artificial Sequence
  synthetic polypeptide
HQSSRLPFT

SEQ ID NO: 143 - protein, 9 aa, Artificial Sequence
  synthetic polypeptide
HQSSFLPFT

SEQ ID NO: 144 - protein, 9 aa, Artificial Sequence
  synthetic polypeptide
HQSSYLPFT

SEQ ID NO: 145 - protein, 9 aa, Artificial Sequence
  synthetic polypeptide
HQSSMLPFT

SEQ ID NO: 146 - protein, 108 aa, Artificial Sequence
  synthetic polypeptide
DIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKR

SEQ ID NO: 147 - protein, 107 aa, Artificial Sequence
  synthetic polypeptide
EIVLTQSPATLSLSPGERATLSCRASKSVGRSLHWYQQKPGQAPRLLIKYASQSLSGIPARFSGSGSGTDFTLTISSLEPEDFAVYYCHQSSRLPFTFGPGTKVDIK

SEQ ID NO: 148 - protein, 108 aa, Artificial Sequence
  synthetic polypeptide
EIVLTQSPATLSLSPGERATLSCRASKSVGWSLHWYQQKPGQAPRLLIKYASQSLSGIPARFSGSGSGTDFTLTISSLEPEDFAVYYCHQSSRLPFTFGPGTKVDIKR

SEQ ID NO: 149 - protein, 108 aa, Artificial Sequence
  synthetic polypeptide
EIVLTQSPATLSLSPGERATLSCRASKSVGYSLHWYQQKPGQAPRLLIKYASQSLSGIPARFSGSGSGTDFTLTISSLEPEDFAVYYCHQSSRLPFTFGPGTKVDIKR

SEQ ID NO: 150 - protein, 108 aa, Artificial Sequence
  synthetic polypeptide
EIVLTQSPATLSLSPGERATLSCRASKAVGWSLHWYQQKPGQAPRLLIKYASQSLSGIPARFSGSGSGTDFTLTISSLEPEDFAVYYCHQSSRLPFTFGPGTKVDIKR

SEQ ID NO: 151 - protein, 108 aa, Artificial Sequence
  synthetic polypeptide
EIVLTQSPATLSLSPGERATLSCRASKSVGQSLHWYQQKPGQAPRLLIKYASQSLSGIPARFSGSGSGTDFTLTISSLEPEDFAVYYCHQSSRLPFTFGPGTKVDIKR

SEQ ID NO: 152 - protein, 108 aa, Artificial Sequence
  synthetic polypeptide
EIVLTQSPATLSLSPGERATLSCRASRSVGLALHWYQQKPGQAPRLLIKYASQSLSGIPARFSGSGSGTDFTLTISSLEPEDFAVYYCHQSSFLPFTFGPGTKVDIKR

SEQ ID NO: 153 - protein, 108 aa, Artificial Sequence
  synthetic polypeptide
EIVLTQSPATLSLSPGERATLSCRASKAVGFSLHWYQQKPGQAPRLLIKYASQSLSGIPARFSGSGSGTDFTLTISSLEPEDFAVYYCHQSSFLPFTFGPGTKVDIKR

SEQ ID NO: 154 - protein, 107 aa, Artificial Sequence
  synthetic polypeptide
EIVLTQSPATLSLSPGERATLSCRASRAVSNLHWYQQKPGQAPRLLIKYASQSLSGIPARFSGSGSGTDFTLTISSLEPEDFAVYYCHQSSYLPFTFGPGTKVDIKR

SEQ ID NO: 155 - protein, 108 aa, Artificial Sequence
  synthetic polypeptide
EIVLTQSPATLSLSPGERATLSCRASKAVWHNLHWYQQKPGQAPRLLIKYASQSLSGIPARFSGSGSGTDFTLTISSLEPEDFAVYYCHQSSMLPFTFGPGTKVDIKR

SEQ ID NO: 156 - protein, 107 aa, Artificial Sequence
  synthetic polypeptide
EIVLTQSPATLSLSPGERATLSCRASQSVGRSLHWYQQKPGQAPRLLIKYASQSLSGIPARFSGSGSGTDFTLTISSLEPEDFAVYYCHQSSRLPFTFGPGTKVDIK

SEQ ID NO: 157 - protein, 5 aa, Artificial Sequence
  synthetic polypeptide
RFAMH

SEQ ID NO: 158 - protein, 5 aa, Artificial Sequence
  synthetic polypeptide
KYAMH

SEQ ID NO: 159 - protein, 5 aa, Artificial Sequence
  synthetic polypeptide
YYAMH

SEQ ID NO: 160 - protein, 5 aa, Artificial Sequence
  synthetic polypeptide
HYAMH

SEQ ID NO: 161 - protein, 5 aa, Artificial Sequence
  synthetic polypeptide
YFAMH

SEQ ID NO: 162 - protein, 5 aa, Artificial Sequence
  synthetic polypeptide
FYAMH

SEQ ID NO: 163 - protein, 5 aa, Artificial Sequence
  synthetic polypeptide
RYAMH

SEQ ID NO: 164 - protein, 17 aa, Artificial Sequence
  synthetic polypeptide
VISYDGGNKYYAESVKG

SEQ ID NO: 165 - protein, 17 aa, Artificial Sequence
  synthetic polypeptide
VISYQGRNKYYAESVKG

SEQ ID NO: 166 - protein, 17 aa, Artificial Sequence
  synthetic polypeptide
VISYNGGNKYYAESVKG

SEQ ID NO: 167 - protein, 17 aa, Artificial Sequence
  synthetic polypeptide
VISFSGGSKYYAESVKG

SEQ ID NO: 168 - protein, 17 aa, Artificial Sequence
  synthetic polypeptide
VINYRGHGKYYAESVKG

SEQ ID NO: 169 - protein, 17 aa, Artificial Sequence
  synthetic polypeptide
VISYSGASKYYAESVKG

SEQ ID NO: 170 - protein, 17 aa, Artificial Sequence
  synthetic polypeptide
VISYSGAFKYYAESVKG

SEQ ID NO: 171 - protein, 17 aa, Artificial Sequence
  synthetic polypeptide
VISYTGAQKYYAESVKG

SEQ ID NO: 172 - protein, 17 aa, Artificial Sequence
  synthetic polypeptide
VISYTGQFKYYAESVKG

SEQ ID NO: 173 - protein, 17 aa, Artificial Sequence
  synthetic polypeptide
VISYMGANKYYAESVKG

SEQ ID NO: 174 - protein, 17 aa, Artificial Sequence
  synthetic polypeptide
VINFQGTTKYYAESVKG

SEQ ID NO: 175 - protein, 17 aa, Artificial Sequence
  synthetic polypeptide
VISYSGDLKYYAESVKG

SEQ ID NO: 176 - protein, 17 aa, Artificial Sequence
  synthetic polypeptide
VITYTGGAKYYAESVKG

SEQ ID NO: 177 - protein, 17 aa, Artificial Sequence
  synthetic polypeptide
VISYSGANKYYAESVKG

SEQ ID NO: 178 - protein, 17 aa, Artificial Sequence
  synthetic polypeptide
VISHYGTNKYYAESVKG

SEQ ID NO: 179 - protein, 17 aa, Artificial Sequence
  synthetic polypeptide
VISYQGSNKYYAESVKG

SEQ ID NO: 180 - protein, 17 aa, Artificial Sequence
  synthetic polypeptide
VINYFGDAKYYAESVKG

SEQ ID NO: 181 - protein, 17 aa, Artificial Sequence
  synthetic polypeptide
VISHSGANKYYAESVKG

SEQ ID NO: 182 - protein, 17 aa, Artificial Sequence
  synthetic polypeptide
VISYSGSNKYYAESVKG

SEQ ID NO: 183 - protein, 17 aa, Artificial Sequence
  synthetic polypeptide
VISSFGSNKYYAESVKG

SEQ ID NO: 184 - protein, 17 aa, Artificial Sequence
  synthetic polypeptide
VISYIGGNKYYAESVKG

SEQ ID NO: 185 - protein, 17 aa, Artificial Sequence
  synthetic polypeptide
VISSMGTNKYYAESVKG

SEQ ID NO: 186 - protein, 17 aa, Artificial Sequence
  synthetic polypeptide
VISYNGRNKYYAESVKG

SEQ ID NO: 187 - protein, 17 aa, Artificial Sequence
  synthetic polypeptide
VISYIGRNKYYAESVKG

SEQ ID NO: 188 - protein, 17 aa, Artificial Sequence
  synthetic polypeptide
VISYNGGNKYYARSVKG

SEQ ID NO: 189 - protein, 17 aa, Artificial Sequence
  synthetic polypeptide
VISYYGGNKYYARSVKG

SEQ ID NO: 190 - protein, 17 aa, Artificial Sequence
  synthetic polypeptide
VISYQGRNKYYARSVKG

SEQ ID NO: 191 - protein, 17 aa, Artificial Sequence
  synthetic polypeptide
VISYYGRNKYYARSVKG

SEQ ID NO: 192 - protein, 17 aa, Artificial Sequence
  synthetic polypeptide
VISYNGNNKYYARSVKG

SEQ ID NO: 193 - protein, 17 aa, Artificial Sequence
  synthetic polypeptide
VISYNGRNKYYARSVKG

SEQ ID NO: 194 - protein, 17 aa, Artificial Sequence
  synthetic polypeptide
VISYIGRNKYYARSVKG

SEQ ID NO: 195 - protein, 11 aa, Artificial Sequence
  synthetic polypeptide
GYDVLTGYPDY

SEQ ID NO: 196 - protein, 11 aa, Artificial Sequence
  synthetic polypeptide
GYDLLTGYPDY

SEQ ID NO: 197 - protein, 11 aa, Artificial Sequence
  synthetic polypeptide
GYDPLTGYPDY

SEQ ID NO: 198 - protein, 11 aa, Artificial Sequence
  synthetic polypeptide
GYDLLSGYPDY

SEQ ID NO: 199 - protein, 120 aa, Artificial Sequence
  synthetic polypeptide
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSS

SEQ ID NO: 200 - protein, 120 aa, Artificial Sequence
  synthetic polypeptide
QVQLVESGGGVVQPGRSLRLSCAASGFTFSRFAMHWVRQAPGKGLEWVAVISYQGRNKYYAESVKGRFTISRDNSKNTLYLQMNSLRAEDTALFYCARGYDVLTGYPDYWGQGTLVTVSS

SEQ ID NO: 201 - protein, 120 aa, Artificial Sequence
  synthetic polypeptide
QVQLVESGGGVVQPGRSLRLSCAASGFTFSRFAMHWVRQAPGKGLEWVAVISYNGGNKYYAESVKGRFTISRDNSKNTLYLQMNSLRAEDTALFYCARGYDVLTGYPDYWGQGTLVTVSS

SEQ ID NO: 202 - protein, 120 aa, Artificial Sequence
  synthetic polypeptide
QVQLVESGGGVVQPGRSLRLSCAASGFTFSRFAMHWVRQAPGKGLEWVGVISFSGGSKYYAESVKGRFTLSRDNSKNTLYLQMNSLRAEDTALFYCARGYDVLTGYPDYWGQGTLVTVSS

SEQ ID NO: 203 - protein, 120 aa, Artificial Sequence
  synthetic polypeptide
QVQLVESGGGVVQPGRSLRLSCAASGFTFSRFAMHWVRQAPGKGLEWVGVINYRGHGKYYAESVKGRFTVSRDNSKNTLYLQMNSLRAEDTALFYCARGYDVLTGYPDYWGQGTLVTVSS

SEQ ID NO: 204 - protein, 120 aa, Artificial Sequence
  synthetic polypeptide
QVQLVESGGGVVQPGRSLRLSCAASGFTFSRFAMHWVRQAPGKGLEWVGVISYSGASKYYAESVKGRFTMSRDNSKNTLYLQMNSLRAEDTALFYCARGYDVLTGYPDYWGQGTLVTVSS

SEQ ID NO: 205 - protein, 120 aa, Artificial Sequence
  synthetic polypeptide
QVQLVESGGGVVQPGRSLRLSCAASGFTFSRFAMHWVRQAPGKGLEWVAVISYSGAFKYYAESVKGRFTVSRDNSKNTLYLQMNSLRAEDTALFYCARGYDVLTGYPDYWGQGTLVTVSS

SEQ ID NO: 206 - protein, 120 aa, Artificial Sequence
  synthetic polypeptide
QVQLVESGGGVVQPGRSLRLSCAASGFTFSRFAMHWVRQAPGKGLEWVGVISYTGAQKYYAESVKGRFTMSRDNSKNTLYLQMNSLRAEDTALFYCARGYDVLTGYPDYWGQGTLVTVSS

SEQ ID NO: 207 - protein, 120 aa, Artificial Sequence
  synthetic polypeptide
QVQLVESGGGVVQPGRSLRLSCAASGFTFSRFAMHWVRQAPGKGLEWVGVISYTGQFKYYAESVKGRFTVSRDNSKNTLYLQMNSLRAEDTALFYCARGYDVLTGYPDYWGQGTLVTVSS

SEQ ID NO: 208 - protein, 120 aa, Artificial Sequence
  synthetic polypeptide
QVQLVESGGGVVQPGRSLRLSCAASGFTFSKYAMHWVRQAPGKGLEWVAVISYMGANKYYAESVKGRFTISRDNSKNTLYLQMNSLRAEDTALFYCARGYDLLTGYPDYWGQGTLVTVSS

SEQ ID NO: 209 - protein, 120 aa, Artificial Sequence
  synthetic polypeptide
QVQLVESGGGVVQPGRSLRLSCAASGFTFSRFAMHWVRQAPGKGLEWVGVINFQGTTKYYAESVKGRFTISRDNSKNTLYLQMNSLRAEDTALFYCARGYDVLTGYPDYWGQGTLVTVSS

SEQ ID NO: 210 - protein, 120 aa, Artificial Sequence
  synthetic polypeptide
QVQLVESGGGVVQPGRSLRLSCAASGFTFSRFAMHWVRQAPGKGLEWVGVISYSGDLKYYAESVKGRFTVSRDNSKNTLYLQMNSLRAEDTALFYCARGYDVLTGYPDYWGQGTLVTVSS

SEQ ID NO: 211 - protein, 120 aa, Artificial Sequence
  synthetic polypeptide
QVQLVESGGGVVQPGRSLRLSCAASGFTFSRFAMHWVRQAPGKGLEWVGVITYTGGAKYYAESVKGRFTISRDNSKNTLYLQMNSLRAEDTALFYCARGYDVLTGYPDYWGQGTLVTVSS

SEQ ID NO: 212 - protein, 120 aa, Artificial Sequence
  synthetic polypeptide
QVQLVESGGGVVQPGRSLRLSCAASGFTFSKYAMHWVRQAPGKGLEWVAVISYSGANKYYAESVKGRFTISRDNSKNTLYLQMNSLRAEDTALFYCARGYDLLTGYPDYWGQGTLVTVSS

SEQ ID NO: 213 - protein, 120 aa, Artificial Sequence
  synthetic polypeptide
QVQLVESGGGVVQPGRSLRLSCAASGFTFSYYAMHWVRQAPGKGLEWVAVISHYGTNKYYAESVKGRFTISRDNSKNTLYLQMNSLRAEDTALFYCARGYDPLTGYPDYWGQGTLVTVSS

SEQ ID NO: 214 - protein, 120 aa, Artificial Sequence
  synthetic polypeptide
QVQLVESGGGVVQPGRSLRLSCAASGFTFSHYAMHWVRQAPGKGLEWVAVISYQGSNKYYAESVKGRFTISRDNSKNTLYLQMNSLRAEDTALFYCARGYDLLTGYPDYWGQGTLVTVSS

SEQ ID NO: 215 - protein, 120 aa, Artificial Sequence
  synthetic polypeptide
QVQLVESGGGVVQPGRSLRLSCAASGFTFSRFAMHWVRQAPGKGLEWVGVINYFGDAKYYAESVKGRFTISRDNSKNTLYLQMNSLRAEDTALFYCARGYDVLTGYPDYWGQGTLVTVSS

SEQ ID NO: 216 - protein, 120 aa, Artificial Sequence
  synthetic polypeptide
QVQLVESGGGVVQPGRSLRLSCAASGFTFSYFAMHWVRQAPGKGLEWVAVISHSGANKYYAESVKGRFTISRDNSKNTLYLQMNSLRAEDTALFYCARGYDLLSGYPDYWGQGTLVTVSS

SEQ ID NO: 217 - protein, 120 aa, Artificial Sequence
  synthetic polypeptide
QVQLVESGGGVVQPGRSLRLSCAASGFTFSYYAMHWVRQAPGKGLEWVAVISYSGSNKYYAESVKGRFTISRDNSKNTLYLQMNSLRAEDTALFYCARGYDLLTGYPDYWGQGTLVTVSS

SEQ ID NO: 218 - protein, 120 aa, Artificial Sequence
  synthetic polypeptide
QVQLVESGGGVVQPGRSLRLSCAASGFTFSFYAMHWVRQAPGKGLEWVAVISSFGSNKYYAESVKGRFTISRDNSKNTLYLQMNSLRAEDTALFYCARGYDLLTGYPDYWGQGTLVTVSS

SEQ ID NO: 219 - protein, 120 aa, Artificial Sequence
  synthetic polypeptide
QVQLVESGGGVVQPGRSLRLSCAASGFTFSRYAMHWVRQAPGKGLEWVAVISYSGANKYYAESVKGRFTISRDNSKNTLYLQMNSLRAEDTALFYCARGYDLLSGYPDYWGQGTLVTVSS

SEQ ID NO: 220 - protein, 120 aa, Artificial Sequence
  synthetic polypeptide
QVQLVESGGGVVQPGRSLRLSCAASGFTFSRFAMHWVRQAPGKGLEWVAVISYIGGNKYYAESVKGRFTISRDNSKNTLYLQMNSLRAEDTALFYCARGYDVLTGYPDYWGQGTLVTVSS

SEQ ID NO: 221 - protein, 120 aa, Artificial Sequence
  synthetic polypeptide
QVQLVESGGGVVQPGRSLRLSCAASGFTFSYYAMHWVRQAPGKGLEWVAVISSMGTNKYYAESVKGRFTISRDNSKNTLYLQMNSLRAEDTALFYCARGYDVLTGYPDYWGQGTLVTVSS

SEQ ID NO: 222 - protein, 120 aa, Artificial Sequence
  synthetic polypeptide
QVQLVESGGGVVQPGRSLRLSCAASGFTFSRFAMHWVRQAPGKGLEWVAVISYNGRNKYYAESVKGRFTISRDNSKNTLYLQMNSLRAEDTALFYCARGYDVLTGYPDYWGQGTLVTVSS

SEQ ID NO: 223 - protein, 120 aa, Artificial Sequence
  synthetic polypeptide
QVQLVESGGGVVQPGRSLRLSCAASGFTFSRFAMHWVRQAPGKGLEWVAVISYIGRNKYYAESVKGRFTISRDNSKNTLYLQMNSLRAEDTALFYCARGYDVLTGYPDYWGQGTLVTVSS

SEQ ID NO: 224 - protein, 120 aa, Artificial Sequence
  synthetic polypeptide
QVQLVESGGGVVQPGRSLRLSCAASGFTFSRFAMHWVRQAPGKGLEWVAVISYNGGNKYYARSVKGRFTISRDNSKNTLYLQMNSLRAEDTALFYCARGYDVLTGYPDYWGQGTLVTVSS

SEQ ID NO: 225 - protein, 120 aa, Artificial Sequence
  synthetic polypeptide
QVQLVESGGGVVQPGRSLRLSCAASGFTFSRFAMHWVRQAPGKGLEWVAVISYYGGNKYYARSVKGRFTISRDNSKNTLYLQMNSLRAEDTALFYCARGYDVLTGYPDYWGQGTLVTVSS

SEQ ID NO: 226 - protein, 120 aa, Artificial Sequence
  synthetic polypeptide
QVQLVESGGGVVQPGRSLRLSCAASGFTFSRFAMHWVRQAPGKGLEWVAVISYQGRNKYYARSVKGRFTISRDNSKNTLYLQMNSLRAEDTALFYCARGYDVLTGYPDYWGQGTLVTVSS

SEQ ID NO: 227 - protein, 120 aa, Artificial Sequence
  synthetic polypeptide
QVQLVESGGGVVQPGRSLRLSCAASGFTFSRFAMHWVRQAPGKGLEWVAVISYYGRNKYYARSVKGRFTISRDNSKNTLYLQMNSLRAEDTALFYCARGYDVLTGYPDYWGQGTLVTVSS

SEQ ID NO: 228 - protein, 120 aa, Artificial Sequence
  synthetic polypeptide
QVQLVESGGGVVQPGRSLRLSCAASGFTFSRFAMHWVRQAPGKGLEWVAVISYNGNNKYYARSVKGRFTISRDNSKNTLYLQMNSLRAEDTALFYCARGYDVLTGYPDYWGQGTLVTVSS

SEQ ID NO: 229 - protein, 120 aa, Artificial Sequence
  synthetic polypeptide
QVQLVESGGGVVQPGRSLRLSCAASGFTFSRFAMHWVRQAPGKGLEWVAVISYNGRNKYYARSVKGRFTISRDNSKNTLYLQMNSLRAEDTALFYCARGYDVLTGYPDYWGQGTLVTVSS

SEQ ID NO: 230 - protein, 120 aa, Artificial Sequence
  synthetic polypeptide
QVQLVESGGGVVQPGRSLRLSCAASGFTFSRFAMHWVRQAPGKGLEWVAVISYIGRNKYYARSVKGRFTISRDNSKNTLYLQMNSLRAEDTALFYCARGYDVLTGYPDYWGQGTLVTVSS

SEQ ID NO: 231 - protein, 214 aa, Artificial Sequence
  synthetic polypeptide
DIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 232 - protein, 214 aa, Artificial Sequence
  synthetic polypeptide
EIVLTQSPATLSLSPGERATLSCRASKSVGRSLHWYQQKPGQAPRLLIKYASQSLSGIPARFSGSGSGTDFTLTISSLEPEDFAVYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 233 - protein, 214 aa, Artificial Sequence
  synthetic polypeptide
EIVLTQSPATLSLSPGERATLSCRASKSVGWSLHWYQQKPGQAPRLLIKYASQSLSGIPARFSGSGSGTDFTLTISSLEPEDFAVYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 234 - protein, 214 aa, Artificial Sequence
  synthetic polypeptide
EIVLTQSPATLSLSPGERATLSCRASKSVGYSLHWYQQKPGQAPRLLIKYASQSLSGIPARFSGSGSGTDFTLTISSLEPEDFAVYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 235 - protein, 214 aa, Artificial Sequence
  synthetic polypeptide
EIVLTQSPATLSLSPGERATLSCRASKAVGWSLHWYQQKPGQAPRLLIKYASQSLSGIPARFSGSGSGTDFTLTISSLEPEDFAVYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 236 - protein, 214 aa, Artificial Sequence
  synthetic polypeptide
EIVLTQSPATLSLSPGERATLSCRASKSVGQSLHWYQQKPGQAPRLLIKYASQSLSGIPARFSGSGSGTDFTLTISSLEPEDFAVYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 237 - protein, 214 aa, Artificial Sequence
  synthetic polypeptide
EIVLTQSPATLSLSPGERATLSCRASRSVGLALHWYQQKPGQAPRLLIKYASQSLSGIPARFSGSGSGTDFTLTISSLEPEDFAVYYCHQSSFLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 238 - protein, 214 aa, Artificial Sequence
  synthetic polypeptide
EIVLTQSPATLSLSPGERATLSCRASKAVGFSLHWYQQKPGQAPRLLIKYASQSLSGIPARFSGSGSGTDFTLTISSLEPEDFAVYYCHQSSFLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 239 - protein, 213 aa, Artificial Sequence
  synthetic polypeptide
EIVLTQSPATLSLSPGERATLSCRASRAVSNLHWYQQKPGQAPRLLIKYASQSLSGIPARFSGSGSGTDFTLTISSLEPEDFAVYYCHQSSYLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 240 - protein, 214 aa, Artificial Sequence
  synthetic polypeptide
EIVLTQSPATLSLSPGERATLSCRASKAVWHNLHWYQQKPGQAPRLLIKYASQSLSGIPARFSGSGSGTDFTLTISSLEPEDFAVYYCHQSSMLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 241 - protein, 214 aa, Artificial Sequence
  synthetic polypeptide
EIVLTQSPATLSLSPGERATLSCRASQSVGRSLHWYQQKPGQAPRLLIKYASQSLSGIPARFSGSGSGTDFTLTISSLEPEDFAVYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 242 - protein, 450 aa, Artificial Sequence
  synthetic polypeptide
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 243 - protein, 450 aa, Artificial Sequence
  synthetic polypeptide
QVQLVESGGGVVQPGRSLRLSCAASGFTFSRFAMHWVRQAPGKGLEWVAVISYQGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 244 - protein, 450 aa, Artificial Sequence
  synthetic polypeptide
QVQLVESGGGVVQPGRSLRLSCAASGFTFSRFAMHWVRQAPGKGLEWVAVISYQGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 245 - protein, 450 aa, Artificial Sequence
  synthetic polypeptide
QVQLVESGGGVVQPGRSLRLSCAASGFTFSRFAMHWVRQAPGKGLEWVAVISYQGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGK

SEQ ID NO: 246 - protein, 450 aa, Artificial Sequence
  synthetic polypeptide
QVQLVESGGGVVQPGRSLRLSCAASGFTFSRFAMHWVRQAPGKGLEWVAVISYQGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTENQVSLTCLVEGFYPSDIAVEWESNGQPENNYETTPPVLDSDGSFFLYSDLTVDKSRWQQGNVFSCSVMHEALHNHYTQKSLSLSPGK

SEQ ID NO: 247 - protein, 450 aa, Artificial Sequence
  synthetic polypeptide
QVQLVESGGGVVQPGRSLRLSCAASGFTFSRFAMHWVRQAPGKGLEWVAVISYQGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 248 - protein, 450 aa, Artificial Sequence
  synthetic polypeptide
QVQLVESGGGVVQPGRSLRLSCAASGFTFSRFAMHWVRQAPGKGLEWVAVISYQGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGK

SEQ ID NO: 249 - protein, 450 aa, Artificial Sequence
  synthetic polypeptide
QVQLVESGGGVVQPGRSLRLSCAASGFTFSRFAMHWVRQAPGKGLEWVAVISYQGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTENQVSLTCLVEGFYPSDIAVEWESNGQPENNYETTPPVLDSDGSFFLYSDLTVDKSRWQQGNVFSCSVMHEALHNHYTQKSLSLSPGK

SEQ ID NO: 250 - protein, 450 aa, Artificial Sequence
  synthetic polypeptide
QVQLVESGGGVVQPGRSLRLSCAASGFTFSRFAMHWVRQAPGKGLEWVAVISYNGGNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 251 - protein, 450 aa, Artificial Sequence
  synthetic polypeptide
QVQLVESGGGVVQPGRSLRLSCAASGFTFSRFAMHWVRQAPGKGLEWVAVISYNGGNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 252 - protein, 450 aa, Artificial Sequence
  synthetic polypeptide
QVQLVESGGGVVQPGRSLRLSCAASGFTFSRFAMHWVRQAPGKGLEWVAVISYNGGNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGK

SEQ ID NO: 253 - protein, 450 aa, Artificial Sequence
  synthetic polypeptide
QVQLVESGGGVVQPGRSLRLSCAASGFTFSRFAMHWVRQAPGKGLEWVAVISYNGGNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTENQVSLTCLVEGFYPSDIAVEWESNGQPENNYETTPPVLDSDGSFFLYSDLTVDKSRWQQGNVFSCSVMHEALHNHYTQKSLSLSPGK

SEQ ID NO: 254 - protein, 450 aa, Artificial Sequence
  synthetic polypeptide
QVQLVESGGGVVQPGRSLRLSCAASGFTFSRFAMHWVRQAPGKGLEWVGVISFSGGSKYYAESVKGRFTLSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 255 - protein, 450 aa, Artificial Sequence
  synthetic polypeptide
QVQLVESGGGVVQPGRSLRLSCAASGFTFSRFAMHWVRQAPGKGLEWVGVISFSGGSKYYAESVKGRFTLSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 256 - protein, 450 aa, Artificial Sequence
  synthetic polypeptide
QVQLVESGGGVVQPGRSLRLSCAASGFTFSRFAMHWVRQAPGKGLEWVGVINYRGHGKYYAESVKGRFTVSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 257 - protein, 450 aa, Artificial Sequence
  synthetic polypeptide
QVQLVESGGGVVQPGRSLRLSCAASGFTFSRFAMHWVRQAPGKGLEWVGVINYRGHGKYYAESVKGRFTVSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 258 - protein, 450 aa, Artificial Sequence
  synthetic polypeptide
QVQLVESGGGVVQPGRSLRLSCAASGFTFSRFAMHWVRQAPGKGLEWVGVISYSGASKYYAESVKGRFTMSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 259 - protein, 450 aa, Artificial Sequence
  synthetic polypeptide
QVQLVESGGGVVQPGRSLRLSCAASGFTFSRFAMHWVRQAPGKGLEWVGVISYSGASKYYAESVKGRFTMSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 260 - protein, 450 aa, Artificial Sequence
  synthetic polypeptide
QVQLVESGGGVVQPGRSLRLSCAASGFTFSRFAMHWVRQAPGKGLEWVAVISYSGAFKYYAESVKGRFTVSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 261 - protein, 450 aa, Artificial Sequence
  synthetic polypeptide
QVQLVESGGGVVQPGRSLRLSCAASGFTFSRFAMHWVRQAPGKGLEWVAVISYSGAFKYYAESVKGRFTVSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 262 - protein, 450 aa, Artificial Sequence
  synthetic polypeptide
QVQLVESGGGVVQPGRSLRLSCAASGFTFSRFAMHWVRQAPGKGLEWVGVISYTGAQKYYAESVKGRFTMSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 263 - protein, 450 aa, Artificial Sequence
  synthetic polypeptide
QVQLVESGGGVVQPGRSLRLSCAASGFTFSRFAMHWVRQAPGKGLEWVGVISYTGAQKYYAESVKGRFTMSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 264 - protein, 450 aa, Artificial Sequence
  synthetic polypeptide
QVQLVESGGGVVQPGRSLRLSCAASGFTFSRFAMHWVRQAPGKGLEWVGVISYTGQFKYYAESVKGRFTVSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 265 - protein, 450 aa, Artificial Sequence
  synthetic polypeptide
QVQLVESGGGVVQPGRSLRLSCAASGFTFSRFAMHWVRQAPGKGLEWVGVISYTGQFKYYAESVKGRFTVSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 266 - protein, 450 aa, Artificial Sequence
  synthetic polypeptide
QVQLVESGGGVVQPGRSLRLSCAASGFTFSKYAMHWVRQAPGKGLEWVAVISYMGANKYYAESVKGRFTISRDNSKNTLYLQMNSLRAEDTALFYCARGYDLLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 267 - protein, 450 aa, Artificial Sequence
  synthetic polypeptide
QVQLVESGGGVVQPGRSLRLSCAASGFTFSKYAMHWVRQAPGKGLEWVAVISYMGANKYYAESVKGRFTISRDNSKNTLYLQMNSLRAEDTALFYCARGYDLLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 268 - protein, 450 aa, Artificial Sequence
  synthetic polypeptide
QVQLVESGGGVVQPGRSLRLSCAASGFTFSRFAMHWVRQAPGKGLEWVGVINFQGTTKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 269 - protein, 450 aa, Artificial Sequence
  synthetic polypeptide
QVQLVESGGGVVQPGRSLRLSCAASGFTFSRFAMHWVRQAPGKGLEWVGVINFQGTTKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 270 - protein, 450 aa, Artificial Sequence
  synthetic polypeptide
QVQLVESGGGVVQPGRSLRLSCAASGFTFSRFAMHWVRQAPGKGLEWVGVISYSGDLKYYAESVKGRFTVSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 271 - protein, 450 aa, Artificial Sequence
  synthetic polypeptide
QVQLVESGGGVVQPGRSLRLSCAASGFTFSRFAMHWVRQAPGKGLEWVGVISYSGDLKYYAESVKGRFTVSRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 272 - protein, 450 aa, Artificial Sequence
  synthetic polypeptide
QVQLVESGGGVVQPGRSLRLSCAASGFTFSRFAMHWVRQAPGKGLEWVGVITYTGGAKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 273 - protein, 450 aa, Artificial Sequence
  synthetic polypeptide
QVQLVESGGGVVQPGRSLRLSCAASGFTFSRFAMHWVRQAPGKGLEWVGVITYTGGAKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 274 - protein, 450 aa, Artificial Sequence
  synthetic polypeptide
QVQLVESGGGVVQPGRSLRLSCAASGFTFSKYAMHWVRQAPGKGLEWVAVISYSGANKYYAESVKGRFTISRDNSKNTLYLQMNSLRAEDTALFYCARGYDLLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 275 - protein, 450 aa, Artificial Sequence
  synthetic polypeptide
QVQLVESGGGVVQPGRSLRLSCAASGFTFSKYAMHWVRQAPGKGLEWVAVISYSGANKYYAESVKGRFTISRDNSKNTLYLQMNSLRAEDTALFYCARGYDLLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 276 - protein, 450 aa, Artificial Sequence
  synthetic polypeptide
QVQLVESGGGVVQPGRSLRLSCAASGFTFSYYAMHWVRQAPGKGLEWVAVISHYGTNKYYAESVKGRFTISRDNSKNTLYLQMNSLRAEDTALFYCARGYDPLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 277 - protein, 450 aa, Artificial Sequence
  synthetic polypeptide
QVQLVESGGGVVQPGRSLRLSCAASGFTFSYYAMHWVRQAPGKGLEWVAVISHYGTNKYYAESVKGRFTISRDNSKNTLYLQMNSLRAEDTALFYCARGYDPLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 278 - protein, 450 aa, Artificial Sequence
  synthetic polypeptide
QVQLVESGGGVVQPGRSLRLSCAASGFTFSHYAMHWVRQAPGKGLEWVAVISYQGSNKYYAESVKGRFTISRDNSKNTLYLQMNSLRAEDTALFYCARGYDLLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 279 - protein, 450 aa, Artificial Sequence
  synthetic polypeptide
QVQLVESGGGVVQPGRSLRLSCAASGFTFSHYAMHWVRQAPGKGLEWVAVISYQGSNKYYAESVKGRFTISRDNSKNTLYLQMNSLRAEDTALFYCARGYDLLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 280 - protein, 450 aa, Artificial Sequence
  synthetic polypeptide
QVQLVESGGGVVQPGRSLRLSCAASGFTFSRFAMHWVRQAPGKGLEWVGVINYFGDAKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 281 - protein, 450 aa, Artificial Sequence
  synthetic polypeptide
QVQLVESGGGVVQPGRSLRLSCAASGFTFSRFAMHWVRQAPGKGLEWVGVINYFGDAKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 282 - protein, 450 aa, Artificial Sequence
  synthetic polypeptide
QVQLVESGGGVVQPGRSLRLSCAASGFTFSYFAMHWVRQAPGKGLEWVAVISHSGANKYYAESVKGRFTISRDNSKNTLYLQMNSLRAEDTALFYCARGYDLLSGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 283 - protein, 450 aa, Artificial Sequence
  synthetic polypeptide
QVQLVESGGGVVQPGRSLRLSCAASGFTFSYFAMHWVRQAPGKGLEWVAVISHSGANKYYAESVKGRFTISRDNSKNTLYLQMNSLRAEDTALFYCARGYDLLSGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 284 - protein, 450 aa, Artificial Sequence
  synthetic polypeptide
QVQLVESGGGVVQPGRSLRLSCAASGFTFSYYAMHWVRQAPGKGLEWVAVISYSGSNKYYAESVKGRFTISRDNSKNTLYLQMNSLRAEDTALFYCARGYDLLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 285 - protein, 450 aa, Artificial Sequence
  synthetic polypeptide
QVQLVESGGGVVQPGRSLRLSCAASGFTFSYYAMHWVRQAPGKGLEWVAVISYSGSNKYYAESVKGRFTISRDNSKNTLYLQMNSLRAEDTALFYCARGYDLLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 286 - protein, 450 aa, Artificial Sequence
  synthetic polypeptide
QVQLVESGGGVVQPGRSLRLSCAASGFTFSFYAMHWVRQAPGKGLEWVAVISSFGSNKYYAESVKGRFTISRDNSKNTLYLQMNSLRAEDTALFYCARGYDLLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 287 - protein, 450 aa, Artificial Sequence
  synthetic polypeptide
QVQLVESGGGVVQPGRSLRLSCAASGFTFSFYAMHWVRQAPGKGLEWVAVISSFGSNKYYAESVKGRFTISRDNSKNTLYLQMNSLRAEDTALFYCARGYDLLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 288 - protein, 450 aa, Artificial Sequence
  synthetic polypeptide
QVQLVESGGGVVQPGRSLRLSCAASGFTFSRYAMHWVRQAPGKGLEWVAVISYSGANKYYAESVKGRFTISRDNSKNTLYLQMNSLRAEDTALFYCARGYDLLSGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 289 - protein, 450 aa, Artificial Sequence
  synthetic polypeptide
QVQLVESGGGVVQPGRSLRLSCAASGFTFSRYAMHWVRQAPGKGLEWVAVISYSGANKYYAESVKGRFTISRDNSKNTLYLQMNSLRAEDTALFYCARGYDLLSGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 290 - protein, 450 aa, Artificial Sequence
  synthetic polypeptide
QVQLVESGGGVVQPGRSLRLSCAASGFTFSRFAMHWVRQAPGKGLEWVAVISYIGGNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 291 - protein, 450 aa, Artificial Sequence
  synthetic polypeptide
QVQLVESGGGVVQPGRSLRLSCAASGFTFSRFAMHWVRQAPGKGLEWVAVISYIGGNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 292 - protein, 450 aa, Artificial Sequence
  synthetic polypeptide
QVQLVESGGGVVQPGRSLRLSCAASGFTFSYYAMHWVRQAPGKGLEWVAVISSMGTNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 293 - protein, 450 aa, Artificial Sequence
  synthetic polypeptide
QVQLVESGGGVVQPGRSLRLSCAASGFTFSYYAMHWVRQAPGKGLEWVAVISSMGTNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 294 - protein, 450 aa, Artificial Sequence
  synthetic polypeptide
QVQLVESGGGVVQPGRSLRLSCAASGFTFSRFAMHWVRQAPGKGLEWVAVISYNGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 295 - protein, 450 aa, Artificial Sequence
  synthetic polypeptide
QVQLVESGGGVVQPGRSLRLSCAASGFTFSRFAMHWVRQAPGKGLEWVAVISYNGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 296 - protein, 450 aa, Artificial Sequence
  synthetic polypeptide
QVQLVESGGGVVQPGRSLRLSCAASGFTFSRFAMHWVRQAPGKGLEWVAVISYIGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 297 - protein, 450 aa, Artificial Sequence
  synthetic polypeptide
QVQLVESGGGVVQPGRSLRLSCAASGFTFSRFAMHWVRQAPGKGLEWVAVISYIGRNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 298 - protein, 450 aa, Artificial Sequence
  synthetic polypeptide
QVQLVESGGGVVQPGRSLRLSCAASGFTFSRFAMHWVRQAPGKGLEWVAVISYNGGNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 299 - protein, 450 aa, Artificial Sequence
  synthetic polypeptide
QVQLVESGGGVVQPGRSLRLSCAASGFTFSRFAMHWVRQAPGKGLEWVAVISYNGGNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 300 - protein, 450 aa, Artificial Sequence
  synthetic polypeptide
QVQLVESGGGVVQPGRSLRLSCAASGFTFSRFAMHWVRQAPGKGLEWVAVISYYGGNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 301 - protein, 450 aa, Artificial Sequence
  synthetic polypeptide
QVQLVESGGGVVQPGRSLRLSCAASGFTFSRFAMHWVRQAPGKGLEWVAVISYYGGNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 302 - protein, 450 aa, Artificial Sequence
  synthetic polypeptide
QVQLVESGGGVVQPGRSLRLSCAASGFTFSRFAMHWVRQAPGKGLEWVAVISYQGRNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 303 - protein, 450 aa, Artificial Sequence
  synthetic polypeptide
QVQLVESGGGVVQPGRSLRLSCAASGFTFSRFAMHWVRQAPGKGLEWVAVISYQGRNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 304 - protein, 450 aa, Artificial Sequence
  synthetic polypeptide
QVQLVESGGGVVQPGRSLRLSCAASGFTFSRFAMHWVRQAPGKGLEWVAVISYYGRNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 305 - protein, 450 aa, Artificial Sequence
  synthetic polypeptide
QVQLVESGGGVVQPGRSLRLSCAASGFTFSRFAMHWVRQAPGKGLEWVAVISYYGRNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 306 - protein, 450 aa, Artificial Sequence
  synthetic polypeptide
QVQLVESGGGVVQPGRSLRLSCAASGFTFSRFAMHWVRQAPGKGLEWVAVISYNGNNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 307 - protein, 450 aa, Artificial Sequence
  synthetic polypeptide
QVQLVESGGGVVQPGRSLRLSCAASGFTFSRFAMHWVRQAPGKGLEWVAVISYNGNNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 308 - protein, 450 aa, Artificial Sequence
  synthetic polypeptide
QVQLVESGGGVVQPGRSLRLSCAASGFTFSRFAMHWVRQAPGKGLEWVAVISYNGRNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 309 - protein, 450 aa, Artificial Sequence
  synthetic polypeptide
QVQLVESGGGVVQPGRSLRLSCAASGFTFSRFAMHWVRQAPGKGLEWVAVISYNGRNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 310 - protein, 450 aa, Artificial Sequence
  synthetic polypeptide
QVQLVESGGGVVQPGRSLRLSCAASGFTFSRFAMHWVRQAPGKGLEWVAVISYIGRNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 311 - protein, 450 aa, Artificial Sequence
  synthetic polypeptide
QVQLVESGGGVVQPGRSLRLSCAASGFTFSRFAMHWVRQAPGKGLEWVAVISYIGRNKYYARSVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 312 - DNA, 642 bp, Artificial Sequence
  synthetic polynucleotide
gatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagcttgagcggtgtgccgtcgcgcttctccggttccggaagcggaacggaattcacgcttacaatctcctcactgcagcccgaggatttcgcgacctattactgtcaccagtcatccagactcccgtttacttttggccctgggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 313 - DNA, 642 bp, Artificial Sequence
  synthetic polynucleotide
gagatcgtacttactcagtcacccgccacattgtccctgagcccgggtgaacgggcgaccctcagctgccgagcatccaagtccgtcggacgatcattgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggaccagggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 314 - DNA, 642 bp, Artificial Sequence
  synthetic polynucleotide
gagatcgtacttactcagtcacccgccacattgtccctgagcccgggtgaacgggcgaccctcagctgccgagcatccaaatccgtcgggtggagcttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggaccagggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 315 - DNA, 642 bp, Artificial Sequence
  synthetic polynucleotide
gagatcgtacttactcagtcacccgccacattgtccctgagcccgggtgaacgggcgaccctcagctgccgagcatccaaatccgtcgggtacagcttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggaccagggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 316 - DNA, 642 bp, Artificial Sequence
  synthetic polynucleotide
gagatcgtacttactcagtcacccgccacattgtccctgagcccgggtgaacgggcgaccctcagctgccgagcatccaaagccgtcgggtggagcttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggaccagggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 317 - DNA, 642 bp, Artificial Sequence
  synthetic polynucleotide
gagatcgtacttactcagtcacccgccacattgtccctgagcccgggtgaacgggcgaccctcagctgccgagcatccaaatcagtcggtcagtctttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgcgtttgcctttcacgtttggaccagggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 318 - DNA, 642 bp, Artificial Sequence
  synthetic polynucleotide
gagatcgtacttactcagtcacccgccacattgtccctgagcccgggtgaacgggcgaccctcagctgccgagcatcccgttcagtcggtctggctttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgttcttgcctttcacgtttggaccagggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 319 - DNA, 642 bp, Artificial Sequence
  synthetic polynucleotide
gagatcgtacttactcagtcacccgccacattgtccctgagcccgggtgaacgggcgaccctcagctgccgagcatccaaagcagtcggtttctctttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgttcttgcctttcacgtttggaccagggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 320 - DNA, 639 bp, Artificial Sequence
  synthetic polynucleotide
gagatcgtacttactcagtcacccgccacattgtccctgagcccgggtgaacgggcgaccctcagctgccgagcatcccgtgcagtctctaacttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgtacttgcctttcacgtttggaccagggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 321 - DNA, 642 bp, Artificial Sequence
  synthetic polynucleotide
gagatcgtacttactcagtcacccgccacattgtccctgagcccgggtgaacgggcgaccctcagctgccgagcatccaaagcagtctggcataacttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgatgttgcctttcacgtttggaccagggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 322 - DNA, 642 bp, Artificial Sequence
  synthetic polynucleotide
gagatcgtacttactcagtcacccgccacattgtccctgagcccgggtgaacgggcgaccctcagctgccgagcatcccagtccgtcggacgatcattgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggaccagggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 323 - DNA, 1350 bp, Artificial Sequence
  synthetic polynucleotide
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 324 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatcagggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 325 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatcagggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 326 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatcagggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcaggacagcctctccctgtctccgggcaaa

SEQ ID NO: 327 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatcagggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccgagaaccaggtcagcctgacctgcctggtcgagggcttctatcccagcgacatcgccgtggagtgggagagcaatgggcagccggagaacaactacgagaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggcaaa

SEQ ID NO: 328 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatcagggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctatatcacccgggagcctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggcaaa

SEQ ID NO: 329 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatcagggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctatatcacccgggagcctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcaggacagcctctccctgtctccgggcaaa

SEQ ID NO: 330 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatcagggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctatatcacccgggagcctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccgagaaccaggtcagcctgacctgcctggtcgagggcttctatcccagcgacatcgccgtggagtgggagagcaatgggcagccggagaacaactacgagaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggcaaa

SEQ ID NO: 331 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatataacggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 332 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatataacggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 333 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatataacggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcaggacagcctctccctgtctccgggcaaa

SEQ ID NO: 334 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatataacggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccgagaaccaggtcagcctgacctgcctggtcgagggcttctatcccagcgacatcgccgtggagtgggagagcaatgggcagccggagaacaactacgaaaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggcaaa

SEQ ID NO: 335 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatatctttttctggaggttctaaatactatgcagagtccgtgaagggccggttcaccttgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 336 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatatctttttctggaggttctaaatactatgcagagtccgtgaagggccggttcaccttgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 337 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatcaactatcgtggacatggtaaatactatgcagagtccgtgaagggccggttcaccgtgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 338 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatcaactatcgtggacatggtaaatactatgcagagtccgtgaagggccggttcaccgtgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 339 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatatcttattctggagcttctaaatactatgcagagtccgtgaagggccggttcaccatgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 340 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatatcttattctggagcttctaaatactatgcagagtccgtgaagggccggttcaccatgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 341 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggctgttatatcttattctggagctttcaaatactatgcagagtccgtgaagggccggttcaccgtgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 342 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggctgttatatcttattctggagctttcaaatactatgcagagtccgtgaagggccggttcaccgtgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 343 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatatcttatactggagctcagaaatactatgcagagtccgtgaagggccggttcaccatgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 344 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatatcttatactggagctcagaaatactatgcagagtccgtgaagggccggttcaccatgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 345 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatctcttatactggacagttcaaatactatgcagagtccgtgaagggccggttcaccgtgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 346 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatctcttatactggacagttcaaatactatgcagagtccgtgaagggccggttcaccgtgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 347 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtaaatacgccatgcactgggtccgccaggctccaggcaaggggctggagtgggtggcagttatctcatacatgggagctaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 348 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtaaatacgccatgcactgggtccgccaggctccaggcaaggggctggagtgggtggcagttatctcatacatgggagctaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 349 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatcaactttcagggaactactaaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 350 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatcaactttcagggaactactaaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 351 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatatcttattctggagatctgaaatactatgcagagtccgtgaagggccggttcaccgtgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 352 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatatcttattctggagatctgaaatactatgcagagtccgtgaagggccggttcaccgtgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 353 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttataacttatactggaggtgctaaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 354 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttataacttatactggaggtgctaaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 355 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtaaatacgccatgcactgggtccgccaggctccaggcaaggggctggagtgggtggcagttatctcatactctggagctaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 356 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtaaatacgccatgcactgggtccgccaggctccaggcaaggggctggagtgggtggcagttatctcatactctggagctaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 357 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagttactacgccatgcactgggtccgccaggctccaggcaaggggctggagtgggtggcagttatctcacattacggaactaataaatactatgcagagtccgtgaagggccggttcaccatctccagagacaattccaagaacaccctgtatctgcaaatgaacagcctgagagctgaggacacggctctgttttactgtgcgagaggatacgatcctctgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 358 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagttactacgccatgcactgggtccgccaggctccaggcaaggggctggagtgggtggcagttatctcacattacggaactaataaatactatgcagagtccgtgaagggccggttcaccatctccagagacaattccaagaacaccctgtatctgcaaatgaacagcctgagagctgaggacacggctctgttttactgtgcgagaggatacgatcctctgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 359 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtcattacgccatgcactgggtccgccaggctccaggcaaggggctggagtgggtggcagttatctcataccagggaagtaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 360 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtcattacgccatgcactgggtccgccaggctccaggcaaggggctggagtgggtggcagttatctcataccagggaagtaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 361 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatcaactatttcggagacgctaaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 362 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatcaactatttcggagacgctaaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 363 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagttacttcgccatgcactgggtccgccaggctccaggcaaggggctggagtgggtggcagttatctcacattctggagctaataaatactatgcagagtccgtgaagggccggttcaccatctccagagacaattccaagaacaccctgtatctgcaaatgaacagcctgagagctgaggacacggctctgttttactgtgcgagaggatacgatctgctgagtggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 364 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagttacttcgccatgcactgggtccgccaggctccaggcaaggggctggagtgggtggcagttatctcacattctggagctaataaatactatgcagagtccgtgaagggccggttcaccatctccagagacaattccaagaacaccctgtatctgcaaatgaacagcctgagagctgaggacacggctctgttttactgtgcgagaggatacgatctgctgagtggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 365 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagttactacgccatgcactgggtccgccaggctccaggcaaggggctggagtgggtggcagttatctcatactctggaagtaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 366 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagttactacgccatgcactgggtccgccaggctccaggcaaggggctggagtgggtggcagttatctcatactctggaagtaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 367 - DNA, 1350 bp, Artificial Sequence
  synthetic polynucleotide
caggtgcagctggtggagtctgggggaggcgtggtccagcctgggaggtccctgagactctcctgtgcagcctctggattcaccttcagtttctacgccatgcactgggtccgccaggctccaggcaaggggctggagtgggtggcagttatctcatctttcggaagtaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 368 - DNA, 1350 bp, Artificial Sequence
  synthetic polynucleotide
caggtgcagctggtggagtctgggggaggcgtggtccagcctgggaggtccctgagactctcctgtgcagcctctggattcaccttcagtttctacgccatgcactgggtccgccaggctccaggcaaggggctggagtgggtggcagttatctcatctttcggaagtaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 369 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtcgttacgccatgcactgggtccgccaggctccaggcaaggggctggagtgggtggcagttatctcatactctggagctaataaatactatgcagagtccgtgaagggccggttcaccatctccagagacaattccaagaacaccctgtatctgcaaatgaacagcctgagagctgaggacacggctctgttttactgtgcgagaggatacgatctgctgagtggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 370 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtcgttacgccatgcactgggtccgccaggctccaggcaaggggctggagtgggtggcagttatctcatactctggagctaataaatactatgcagagtccgtgaagggccggttcaccatctccagagacaattccaagaacaccctgtatctgcaaatgaacagcctgagagctgaggacacggctctgttttactgtgcgagaggatacgatctgctgagtggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 371 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatatcggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 372 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatatcggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 373 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagttactacgccatgcactgggtccgccaggctccaggcaaggggctggagtgggtggcagttatctcatctatgggaactaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 374 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagttactacgccatgcactgggtccgccaggctccaggcaaggggctggagtgggtggcagttatctcatctatgggaactaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 375 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatataacggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 376 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatataacggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 377 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatatcggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 378 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatatcggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 379 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatataacggaggaaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 380 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatataacggaggaaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 381 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatattacggaggaaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 382 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatattacggaggaaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 383 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatcagggacgcaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 384 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatcagggacgcaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 385 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatattacggacgcaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 386 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatattacggacgcaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 387 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatataacggaaacaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 388 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatataacggaaacaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 389 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatataacggacgcaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 390 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatataacggacgcaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 391 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatatcggacgcaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 392 - DNA, 1350 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatatcggacgcaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 393 - DNA, 333 bp, Artificial Sequence
  synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctaggt

SEQ ID NO: 394 - DNA, 333 bp, Artificial Sequence
  synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggt

SEQ ID NO: 395 - DNA, 333 bp, Artificial Sequence
  synthetic polynucleotide
cagtctgtgttgacgcagccgccctcagtgtctgcggccccaggacagaaggtcaccatctcctgctctggaagctactccaacattgggcgttactctgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggt

SEQ ID NO: 396 - DNA, 333 bp, Artificial Sequence
  synthetic polynucleotide
cagtctgtgttgacgcagccgccctcagtgtctgcggccccaggacagaaggtcaccatctcctgctctggaagccgttccaacattgggatcaaagctgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggt

SEQ ID NO: 397 - DNA, 333 bp, Artificial Sequence
  synthetic polynucleotide
cagtctgtgttgacgcagccgccctcagtgtctgcggccccaggacagaaggtcaccatctcctgctctggaagcttctccaacattgggcgttctactgtatcctggtaccagcagctcccaggaacagcccccaaactcctcatttatgacaatcgttggcgcgcgggtgggattcctgaccgattctctggctccaagtctggcacgtcagccaccctgggcatcaccggactccagactggggacgaggccgattattactgcggaacatgggattaccagtggaaagctgtggttttcggcggagggaccaagctgaccgtcctaggt

SEQ ID NO: 398 - DNA, 333 bp, Artificial Sequence
  synthetic polynucleotide
cagtctgtgttgacgcagccgccctcagtgtctgcggccccaggacagaaggtcaccatctcctgctctggaagctactccaacattgggcgtaaatctgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggt

SEQ ID NO: 399 - DNA, 333 bp, Artificial Sequence
  synthetic polynucleotide
cagtctgtgttgacgcagccgccctcagtgtctgcggccccaggacagaaggtcaccatctcctgctctggaagctactccaacattgggtggtggccggtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggt

SEQ ID NO: 400 - DNA, 333 bp, Artificial Sequence
  synthetic polynucleotide
cagtctgtgttgacgcagccgccctcagtgtctgcggccccaggacagaaggtcaccatctcctgctctggaagccgttccaacattgggcgttactctgtatcctggtaccagcagctcccaggaacagcccccaaactcctcatttatgaaaatatgttccgcccgcgtgggattcctgaccgattctctggctccaagtctggcacgtcagccaccctgggcatcaccggactccagactggggacgaggccgattattactgcggaacatgggattaccgtatgcaggctgtggttttcggcggagggaccaagctgaccgtcctaggt

SEQ ID NO: 401 - DNA, 333 bp, Artificial Sequence
  synthetic polynucleotide
cagtctgtgttgacgcagccgccctcagtgtctgcggccccaggacagaaggtcaccatctcctgctctggaagccgttccaacattgggcgttactctgtatcctggtaccagcagctcccaggaacagcccccaaactcctcatttatgacaatcgttaccgcgcgcaggggattcctgaccgattctctggctccaagtctggcacgtcagccaccctgggcatcaccggactccagactggggacgaggccgattattactgcggaacatgggattgggctactacttctgtggttttcggcggagggaccaagctgaccgtcctaggt

SEQ ID NO: 402 - DNA, 333 bp, Artificial Sequence
  synthetic polynucleotide
cagtctgtgttgacgcagccgccctcagtgtctgcggccccaggacagaaggtcaccatctcctgctctggaagccgttccaacattgggcgtcgtactgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggt

SEQ ID NO: 403 - DNA, 333 bp, Artificial Sequence
  synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggattcttggcatcgtgttgtgactttcggcggagggaccaagctgaccgtcctaggt

SEQ ID NO: 404 - DNA, 333 bp, Artificial Sequence
  synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggattggtggcgtaaagctgtgattttcggcggagggaccaagctgaccgtcctaggt

SEQ ID NO: 405 - DNA, 390 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggaccacggtcaccgtctctagt

SEQ ID NO: 406 - DNA, 390 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtctctagt

SEQ ID NO: 407 - DNA, 390 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaactactatcgtagtttcggttattatggttaccattactacggtatggccgtctggggccaagggacaacagttaccgtctctagt

SEQ ID NO: 408 - DNA, 390 bp, Artificial Sequence
  synthetic polynucleotide
caggtgcagctggtggaatctgggggaggcgtggtccagcctgggaggtccctgagactctcctgtgcagcctctggattctacttcatgacttatggtatgcactgggtccgccaggctccaggcaaggggctggagtgggtggcagttatatcatttgatgggagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtctctagt

SEQ ID NO: 409 - DNA, 390 bp, Artificial Sequence
  synthetic polynucleotide
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgctggagaaatcgactactacgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtctctagt

SEQ ID NO: 410 - DNA, 390 bp, Artificial Sequence
  synthetic polynucleotide
caggtgcagctggtggaatctgggggaggcgtggtccagcctgggaggtccctgagactctcctgtgcagcctctggattcttcttcggttcttatggtatgcactgggtccgccaggctccaggcaaggggctggagtgggtggcagttatatcatttgctggagaaatcgaacattacgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtctctagt

SEQ ID NO: 411 - DNA, 390 bp, Artificial Sequence
  synthetic polynucleotide
caggtgcagctggtggaatctgggggaggcgtggtccagcctgggaggtccctgagactctcctgtgcagcctctggattctggttcgacacttttggtatgcactgggtccgccaggctccaggcaaggggctggagtgggtggcagttatatcatttgctggagaagacactcattacgtagactccgtgaagggccgattcaccatctccagagacaattcaaagaacacgctgtttctgcaaatgaacagcctgcgagccgaggacacggctgtgtattactgtgcgagagatcggctcaactactatgaaagttacggttattatggttaccattactacggtatggccgtctggggccaagggacaacagttaccgtctctagt

SEQ ID NO: 412 - DNA, 326 bp, Artificial Sequence
  synthetic polynucleotide
gatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagcttgagcggtgtgccgtcgcgcttctccggttccggaagcggaacggaattcacgcttacaatctcctcactgcagcccgaggatttcgcgacctattactgtcaccagtcatccagactcccgtttacttttggccctgggaccaaggtggacattaagcgtac

SEQ ID NO: 413 - DNA, 321 bp, Artificial Sequence
  synthetic polynucleotide
gagatcgtacttactcagtcacccgccacattgtccctgagcccgggtgaacgggcgaccctcagctgccgagcatccaagtccgtcggacgatcattgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggaccagggaccaaggtggacattaag

SEQ ID NO: 414 - DNA, 325 bp, Artificial Sequence
  synthetic polynucleotide
gagatcgtacttactcagtcacccgccacattgtccctgagcccgggtgaacgggcgaccctcagctgccgagcatccaaatccgtcgggtggagcttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggaccagggaccaaggtggacattaagcgta

SEQ ID NO: 415 - DNA, 325 bp, Artificial Sequence
  synthetic polynucleotide
gagatcgtacttactcagtcacccgccacattgtccctgagcccgggtgaacgggcgaccctcagctgccgagcatccaaatccgtcgggtacagcttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggaccagggaccaaggtggacattaagcgta

SEQ ID NO: 416 - DNA, 325 bp, Artificial Sequence
  synthetic polynucleotide
gagatcgtacttactcagtcacccgccacattgtccctgagcccgggtgaacgggcgaccctcagctgccgagcatccaaagccgtcgggtggagcttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggaccagggaccaaggtggacattaagcgta

SEQ ID NO: 417 - DNA, 324 bp, Artificial Sequence
  synthetic polynucleotide
gagatcgtacttactcagtcacccgccacattgtccctgagcccgggtgaacgggcgaccctcagctgccgagcatccaaatcagtcggtcagtctttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgcgtttgcctttcacgtttggaccagggaccaaggtggacattaagcgt

SEQ ID NO: 418 - DNA, 325 bp, Artificial Sequence
  synthetic polynucleotide
gagatcgtacttactcagtcacccgccacattgtccctgagcccgggtgaacgggcgaccctcagctgccgagcatcccgttcagtcggtctggctttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgttcttgcctttcacgtttggaccagggaccaaggtggacattaagcgta

SEQ ID NO: 419 - DNA, 324 bp, Artificial Sequence
  synthetic polynucleotide
gagatcgtacttactcagtcacccgccacattgtccctgagcccgggtgaacgggcgaccctcagctgccgagcatccaaagcagtcggtttctctttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgttcttgcctttcacgtttggaccagggaccaaggtggacattaagcgt

SEQ ID NO: 420 - DNA, 321 bp, Artificial Sequence
  synthetic polynucleotide
gagatcgtacttactcagtcacccgccacattgtccctgagcccgggtgaacgggcgaccctcagctgccgagcatcccgtgcagtctctaacttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgtacttgcctttcacgtttggaccagggaccaaggtggacattaagcgt

SEQ ID NO: 421 - DNA, 324 bp, Artificial Sequence
  synthetic polynucleotide
gagatcgtacttactcagtcacccgccacattgtccctgagcccgggtgaacgggcgaccctcagctgccgagcatccaaagcagtctggcataacttgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgatgttgcctttcacgtttggaccagggaccaaggtggacattaagcgt

SEQ ID NO: 422 - DNA, 321 bp, Artificial Sequence
  synthetic polynucleotide
gagatcgtacttactcagtcacccgccacattgtccctgagcccgggtgaacgggcgaccctcagctgccgagcatcccagtccgtcggacgatcattgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggaccagggaccaaggtggacattaag

SEQ ID NO: 423 - DNA, 360 bp, Artificial Sequence
  synthetic polynucleotide
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagt

SEQ ID NO: 424 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatatcagggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 425 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatataacggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 426 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatatctttttctggaggttctaaatactatgcagagtccgtgaagggccggttcaccttgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagt

SEQ ID NO: 427 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatcaactatcgtggacatggtaaatactatgcagagtccgtgaagggccggttcaccgtgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagt

SEQ ID NO: 428 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatatcttattctggagcttctaaatactatgcagagtccgtgaagggccggttcaccatgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagt

SEQ ID NO: 429 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggctgttatatcttattctggagctttcaaatactatgcagagtccgtgaagggccggttcaccgtgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagt

SEQ ID NO: 430 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatatcttatactggagctcagaaatactatgcagagtccgtgaagggccggttcaccatgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagt

SEQ ID NO: 431 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatctcttatactggacagttcaaatactatgcagagtccgtgaagggccggttcaccgtgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagt

SEQ ID NO: 432 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtaaatacgccatgcactgggtccgccaggctccaggcaaggggctggagtgggtggcagttatctcatacatgggagctaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagt

SEQ ID NO: 433 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatcaactttcagggaactactaaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagt

SEQ ID NO: 434 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatatcttattctggagatctgaaatactatgcagagtccgtgaagggccggttcaccgtgtccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagt

SEQ ID NO: 435 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttataacttatactggaggtgctaaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagt

SEQ ID NO: 436 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtaaatacgccatgcactgggtccgccaggctccaggcaaggggctggagtgggtggcagttatctcatactctggagctaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagt

SEQ ID NO: 437 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagttactacgccatgcactgggtccgccaggctccaggcaaggggctggagtgggtggcagttatctcacattacggaactaataaatactatgcagagtccgtgaagggccggttcaccatctccagagacaattccaagaacaccctgtatctgcaaatgaacagcctgagagctgaggacacggctctgttttactgtgcgagaggatacgatcctctgactggttaccccgactactggggccagggaaccctggtcaccgtgtctagt

SEQ ID NO: 438 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtcattacgccatgcactgggtccgccaggctccaggcaaggggctggagtgggtggcagttatctcataccagggaagtaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagt

SEQ ID NO: 439 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtgggtgttatcaactatttcggagacgctaaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagt

SEQ ID NO: 440 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagttacttcgccatgcactgggtccgccaggctccaggcaaggggctggagtgggtggcagttatctcacattctggagctaataaatactatgcagagtccgtgaagggccggttcaccatctccagagacaattccaagaacaccctgtatctgcaaatgaacagcctgagagctgaggacacggctctgttttactgtgcgagaggatacgatctgctgagtggttaccccgactactggggccagggaaccctggtcaccgtgtctagt

SEQ ID NO: 441 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagttactacgccatgcactgggtccgccaggctccaggcaaggggctggagtgggtggcagttatctcatactctggaagtaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagt

SEQ ID NO: 442 - DNA, 360 bp, Artificial Sequence
  synthetic polynucleotide
caggtgcagctggtggagtctgggggaggcgtggtccagcctgggaggtccctgagactctcctgtgcagcctctggattcaccttcagtttctacgccatgcactgggtccgccaggctccaggcaaggggctggagtgggtggcagttatctcatctttcggaagtaataaatactatgcagagtccgtgaagggccggttcaccatctccagagacaattccaagaacaccctgtatctgcaaatgaacagcctgagagctgaggacacggctctgttttactgtgcgagaggatacgatctgctgactggttaccccgactactggggccagggaaccctggtcaccgtgtctagt

SEQ ID NO: 443 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtcgttacgccatgcactgggtccgccaggctccaggcaaggggctggagtgggtggcagttatctcatactctggagctaataaatactatgcagagtccgtgaagggccggttcaccatctccagagacaattccaagaacaccctgtatctgcaaatgaacagcctgagagctgaggacacggctctgttttactgtgcgagaggatacgatctgctgagtggttaccccgactactggggccagggaaccctggtcaccgtgtctagt

SEQ ID NO: 444 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatctcatatatcggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagt

SEQ ID NO: 445 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagttactacgccatgcactgggtccgccaggctccaggcaaggggctggagtgggtggcagttatctcatctatgggaactaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtgtctagt

SEQ ID NO: 446 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatataacggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 447 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatatatcggacgcaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 448 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatataacggaggaaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 449 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatattacggaggaaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 450 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatatcagggacgcaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 451 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatattacggacgcaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 452 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatataacggaaacaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 453 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatataacggacgcaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 454 - DNA, 360 bp, Artificial Sequence
  synthetic polynucleotide
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatatatcggacgcaataaatactatgcacgctccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 455 - protein, 22 aa, Artificial Sequence
  synthetic polypeptide
MDMRVPAQLLGLLLLWLRGARC

SEQ ID NO: 456 - protein, 19 aa, Artificial Sequence
  synthetic polypeptide
MAWALLLLTLLTQGTGSWA

SEQ ID NO: 457 - protein, 19 aa, Artificial Sequence
  synthetic polypeptide
MTCSPLLLTLLIHCTGSWA

SEQ ID NO: 458 - protein, 20 aa, Artificial Sequence
  synthetic polypeptide
MEAPAQLLFLLLLWLPDTTG

SEQ ID NO: 459 - protein, 19 aa, Artificial Sequence
  synthetic polypeptide
MEWTWRVLFLVAAATGAHS

SEQ ID NO: 460 - protein, 20 aa, Artificial Sequence
  synthetic polypeptide
METPAQLLFLLLLWLPDTTG

SEQ ID NO: 461 - protein, 20 aa, Artificial Sequence
  synthetic polypeptide
METPAQLLFLLLLWLPDTTG

SEQ ID NO: 462 - protein, 19 aa, Artificial Sequence
  synthetic polypeptide
MKHLWFFLLLVAAPRWVLS

SEQ ID NO: 463 - protein, 19 aa, Artificial Sequence
  synthetic polypeptide
MEWSWVFLFFLSVTTGVHS

SEQ ID NO: 464 - protein, 22 aa, Artificial Sequence
  synthetic polypeptide
MDIRAPTQLLGLLLLWLPGAKC

SEQ ID NO: 465 - protein, 22 aa, Artificial Sequence
  synthetic polypeptide
MDIRAPTQLLGLLLLWLPGARC

SEQ ID NO: 466 - protein, 22 aa, Artificial Sequence
  synthetic polypeptide
MDTRAPTQLLGLLLLWLPGATF

SEQ ID NO: 467 - protein, 22 aa, Artificial Sequence
  synthetic polypeptide
MDTRAPTQLLGLLLLWLPGARC

SEQ ID NO: 468 - protein, 19 aa, Artificial Sequence
  synthetic polypeptide
METGLRWLLLVAVLKGVQC

SEQ ID NO: 469 - protein, 21 aa, Artificial Sequence
  synthetic polypeptide
METGLRWLLLVAVLKGVQCQE

SEQ ID NO: 470 - protein, 22 aa, Artificial Sequence
  synthetic polypeptide
MDMRAPTQLLGLLLLWLPGARC

SEQ ID NO: 471 - protein, 8 aa, Artificial Sequence
  synthetic polypeptide
  MISC_FEATURE (1)..(1): X is N, K, R, H, F, W, or Y
  MISC_FEATURE (3)..(3): X is S, G, D, or M
  MISC_FEATURE (4)..(4): X is S, T, N, K, R, or H
  MISC_FEATURE (5)..(5): X is F or Y
XFXXXGMH

SEQ ID NO: 472 - protein, 8 aa, Artificial Sequence
  synthetic polypeptide
  MISC_FEATURE (1)..(1): X is N, K, R, or H
  MISC_FEATURE (4)..(4): X is S, T, N, K, R, or H
XFSXFGMH

SEQ ID NO: 473 - protein, 17 aa, Artificial Sequence
  synthetic polypeptide
  MISC_FEATURE (5)..(5): X is D or A
  MISC_FEATURE (7)..(7): X is S or E
  MISC_FEATURE (8)..(8): X is I or D
  MISC_FEATURE (9)..(9): X is K, E, T, or D
  MISC_FEATURE (10)..(10): X is Y or H
  MISC_FEATURE (11)..(11): X is S or Y
VISFXGXXXXXVDSVKG

SEQ ID NO: 474 - protein, 21 aa, Artificial Sequence
  synthetic polypeptide
  MISC_FEATURE (4)..(4): X is N, D, or E
  MISC_FEATURE (7)..(7): X is D, E, or R
  MISC_FEATURE (9)..(9): X is S, Y, or F
  MISC_FEATURE (13)..(13): X is G or H
  MISC_FEATURE (15)..(15): X is K or H
DRLXYYXSXGYYXYXYYGMAV

SEQ ID NO: 475 - protein, 13 aa, Artificial Sequence
  synthetic polypeptide
  MISC_FEATURE (4)..(4): X is F, R, Y, or S
  MISC_FEATURE (9)..(9): X is N, R, I, or W
  MISC_FEATURE (10)..(10): X is N, S, Y, R, K, or W
  MISC_FEATURE (11)..(11): X is Y, T, S, A, or P
SGSXSNIGXXXVS

SEQ ID NO: 476 - protein, 7 aa, Artificial Sequence
  synthetic polypeptide
  MISC_FEATURE (3)..(3): X is N, R, or M
  MISC_FEATURE (4)..(4): X is K, W, F, or Y
  MISC_FEATURE (6)..(6): X is P or A
  MISC_FEATURE (7)..(7): X is S, G, R, or Q
DNXXRXX

SEQ ID NO: 477 - protein, 11 aa, Artificial Sequence
  synthetic polypeptide
  MISC_FEATURE (5)..(5): X is S, Y, or W
  MISC_FEATURE (6)..(6): X is R, Q, A, or W
  MISC_FEATURE (7)..(7): X is L, W, M, T, H, or R
  MISC_FEATURE (8)..(8): X is S, K, Q, T, or R
  MISC_FEATURE (9)..(9): X is A, S, or V
  MISC_FEATURE (11)..(11): X is V, T, or I
GTWDXXXXXVX

What is claimed:

1. A bispecific antigen binding protein comprising a first binding domain that specifically binds to human calcitonin gene-related peptide (CGRP) receptor and a second binding domain that specifically binds to human pituitary adenylate cyclase-activating polypeptide type I (PAC1) receptor, wherein the first binding domain comprises a first light chain immunoglobulin variable region (VL1) and a first heavy chain immunoglobulin variable region (VH1), and the second binding domain comprises a second light chain immunoglobulin variable region (VL2) and a second heavy chain immunoglobulin variable region (VH2), and wherein VL1 comprises a CDRL1, a CDRL2, and a CDRL3 having the sequence of SEQ ID NOs: 6, 13, and 17, respectively, and VH1 comprises a CDRH1, a CDRH2, and a CDRH3 having the sequence of SEQ ID NOs: 35, 39, and 44, respectively.

2. The bispecific antigen binding protein of claim 1, wherein VL1 comprises a sequence that is at least 90% identical to the amino acid sequence of SEQ ID NO: 25.

3. The bispecific antigen binding protein of claim 1, wherein VH1 comprises a sequence that is at least 90% identical to the amino acid sequence of SEQ ID NO: 48.

4. The bispecific antigen binding protein of claim 1, wherein:

VL1 comprises the sequence of SEQ ID NO: 25 and VH1 comprises the sequence of SEQ ID NO: 48.

5. The bispecific antigen binding protein of claim 1, wherein VL2 comprises (i) a CDRL1 selected from SEQ ID NOs: 130-140, (ii) a CDRL2 having the sequence of SEQ ID NO: 141, and (iii) a CDRL3 selected from SEQ ID NOs: 142-145, and VH2 comprises (i) a CDRH1 selected from SEQ ID NOs: 157-163, (ii) a CDRH2 selected from SEQ ID NOs: 164-194, and (iii) a CDRH3 selected from SEQ ID NOs: 195-198.

6. The bispecific antigen binding protein of claim 5, wherein:

(a) CDRL1, CDRL2, and CDRL3 of VL2 have the sequence of SEQ ID NOs: 131, 141 and 142, respectively, and CDRH1, CDRH2, and CDRH3 of VH2 have the sequence of SEQ ID NOs: 157, 165 and 195, respectively;

(b) CDRL1, CDRL2, and CDRL3 of VL2 have the sequence of SEQ ID NOs: 131, 141 and 142, respectively, and CDRH1, CDRH2, and CDRH3 of VH2 have the sequence of SEQ ID NOs: 157, 166 and 195, respectively;

(c) CDRL1, CDRL2, and CDRL3 of VL2 have the sequence of SEQ ID NOs: 132, 141 and 142, respectively, and CDRH1, CDRH2, and CDRH3 of VH2 have the sequence of SEQ ID NOs: 157, 167 and 195, respectively;

(d) CDRL1, CDRL2, and CDRL3 of VL2 have the sequence of SEQ ID NOs: 132, 141 and 142, respectively, and CDRH1, CDRH2, and CDRH3 of VH2 have the sequence of SEQ ID NOs: 157, 168 and 195, respectively;

(e) CDRL1, CDRL2, and CDRL3 of VL2 have the sequence of SEQ ID NOs: 132, 141 and 142, respectively, and CDRH1, CDRH2, and CDRH3 of VH2 have the sequence of SEQ ID NOs: 157, 169 and 195, respectively;

(f) CDRL1, CDRL2, and CDRL3 of VL2 have the sequence of SEQ ID NOs: 132, 141 and 142, respectively, and CDRH1, CDRH2, and CDRH3 of VH2 have the sequence of SEQ ID NOs: 157, 170 and 195, respectively;

(g) CDRL1, CDRL2, and CDRL3 of VL2 have the sequence of SEQ ID NOs: 132, 141 and 142, respectively, and CDRH1, CDRH2, and CDRH3 of VH2 have the sequence of SEQ ID NOs: 157, 171 and 195, respectively;

(h) CDRL1, CDRL2, and CDRL3 of VL2 have the sequence of SEQ ID NOs: 133, 141 and 142, respectively, and CDRH1, CDRH2, and CDRH3 of VH2 have the sequence of SEQ ID NOs: 157, 172 and 195, respectively;

(i) CDRL1, CDRL2, and CDRL3 of VL2 have the sequence of SEQ ID NOs: 132, 141 and 142, respectively, and CDRH1, CDRH2, and CDRH3 of VH2 have the sequence of SEQ ID NOs: 158, 173 and 196, respectively;

(j) CDRL1, CDRL2, and CDRL3 of VL2 have the sequence of SEQ ID NOs: 132, 141 and 142, respectively, and CDRH1, CDRH2, and CDRH3 of VH2 have the sequence of SEQ ID NOs: 157, 174 and 195, respectively;

(k) CDRL1, CDRL2, and CDRL3 of VL2 have the sequence of SEQ ID NOs: 132, 141 and 142, respectively, and CDRH1, CDRH2, and CDRH3 of VH2 have the sequence of SEQ ID NOs: 157, 175 and 195, respectively;

(l) CDRL1, CDRL2, and CDRL3 of VL2 have the sequence of SEQ ID NOs: 134, 141 and 142, respectively, and CDRH1, CDRH2, and CDRH3 of VH2 have the sequence of SEQ ID NOs: 157, 176 and 195, respectively;

(m) CDRL1, CDRL2, and CDRL3 of VL2 have the sequence of SEQ ID NOs: 135, 141 and 142, respectively, and CDRH1, CDRH2, and CDRH3 of VH2 have the sequence of SEQ ID NOs: 158, 177 and 196, respectively;

(n) CDRL1, CDRL2, and CDRL3 of VL2 have the sequence of SEQ ID NOs: 135, 141 and 142, respectively, and CDRH1, CDRH2, and CDRH3 of VH2 have the sequence of SEQ ID NOs: 159, 178 and 197, respectively;

(o) CDRL1, CDRL2, and CDRL3 of VL2 have the sequence of SEQ ID NOs: 136, 141 and 143, respectively, and CDRH1, CDRH2, and CDRH3 of VH2 have the sequence of SEQ ID NOs: 160, 179 and 196, respectively;

(p) CDRL1, CDRL2, and CDRL3 of VL2 have the sequence of SEQ ID NOs: 132, 141 and 142, respectively, and CDRH1, CDRH2, and CDRH3 of VH2 have the sequence of SEQ ID NOs: 157, 180 and 195, respectively;

(q) CDRL1, CDRL2, and CDRL3 of VL2 have the sequence of SEQ ID NOs: 135, 141 and 142, respectively, and CDRH1, CDRH2, and CDRH3 of VH2 have the sequence of SEQ ID NOs: 161, 181 and 198, respectively;

(r) CDRL1, CDRL2, and CDRL3 of VL2 have the sequence of SEQ ID NOs: 135, 141 and 142, respectively, and CDRH1, CDRH2, and CDRH3 of VH2 have the sequence of SEQ ID NOs: 159, 182 and 196, respectively;

(s) CDRL1, CDRL2, and CDRL3 of VL2 have the sequence of SEQ ID NOs: 135, 141 and 142, respectively, and CDRH1, CDRH2, and CDRH3 of VH2 have the sequence of SEQ ID NOs: 162, 183 and 196, respectively;

(t) CDRL1, CDRL2, and CDRL3 of VL2 have the sequence of SEQ ID NOs: 137, 141 and 143, respectively, and CDRH1, CDRH2, and CDRH3 of VH2 have the sequence of SEQ ID NOs: 163, 177 and 198, respectively;

(u) CDRL1, CDRL2, and CDRL3 of VL2 have the sequence of SEQ ID NOs: 138, 141 and 144, respectively, and CDRH1, CDRH2, and CDRH3 of VH2 have the sequence of SEQ ID NOs: 157, 184 and 195, respectively;

(v) CDRL1, CDRL2, and CDRL3 of VL2 have the sequence of SEQ ID NOs: 139, 141 and 145, respectively, and CDRH1, CDRH2, and CDRH3 of VH2 have the sequence of SEQ ID NOs: 159, 185 and 195, respectively;

(w) CDRL1, CDRL2, and CDRL3 of VL2 have the sequence of SEQ ID NOs: 131, 141 and 142, respectively, and CDRH1, CDRH2, and CDRH3 of VH2 have the sequence of SEQ ID NOs: 157, 184 and 195, respectively;

(x) CDRL1, CDRL2, and CDRL3 of VL2 have the sequence of SEQ ID NOs: 131, 141 and 142, respectively, and CDRH1, CDRH2, and CDRH3 of VH2 have the sequence of SEQ ID NOs: 157, 186 and 195, respectively;

(y) CDRL1, CDRL2, and CDRL3 of VL2 have the sequence of SEQ ID NOs: 131, 141 and 142, respectively, and CDRH1, CDRH2, and CDRH3 of VH2 have the sequence of SEQ ID NOs: 157, 187 and 195, respectively;

(z) CDRL1, CDRL2, and CDRL3 of VL2 have the sequence of SEQ ID NOs: 131, 141 and 142, respectively, and CDRH1, CDRH2, and CDRH3 of VH2 have the sequence of SEQ ID NOs: 157, 188 and 195, respectively;

(aa) CDRL1, CDRL2, and CDRL3 of VL2 have the sequence of SEQ ID NOs: 131, 141 and 142, respectively, and CDRH1, CDRH2, and CDRH3 of VH2 have the sequence of SEQ ID NOs: 157, 189 and 195, respectively;

(ab) CDRL1, CDRL2, and CDRL3 of VL2 have the sequence of SEQ ID NOs: 140, 141 and 142, respectively, and CDRH1, CDRH2, and CDRH3 of VH2 have the sequence of SEQ ID NOs: 157, 190 and 195, respectively;

(ac) CDRL1, CDRL2, and CDRL3 of VL2 have the sequence of SEQ ID NOs: 140, 141 and 142, respectively, and CDRH1, CDRH2, and CDRH3 of VH2 have the sequence of SEQ ID NOs: 157, 191 and 195, respectively;

(ad) CDRL1, CDRL2, and CDRL3 of VL2 have the sequence of SEQ ID NOs: 140, 141 and 142, respectively, and CDRH1, CDRH2, and CDRH3 of VH2 have the sequence of SEQ ID NOs: 157, 192 and 195, respectively;

(ae) CDRL1, CDRL2, and CDRL3 of VL2 have the sequence of SEQ ID NOs: 131, 141 and 142, respectively, and CDRH1, CDRH2, and CDRH3 of VH2 have the sequence of SEQ ID NOs: 157, 193 and 195, respectively; or (af) CDRL1, CDRL2, and CDRL3 of VL2 have the sequence of SEQ ID NOs: 131, 141 and 142, respectively, and CDRH1, CDRH2, and CDRH3 of VH2 have the sequence of SEQ ID NOs: 157, 194 and 195, respectively.

7. The bispecific antigen binding protein of claim 1, wherein VL2 comprises a sequence that is at least 90% identical to an amino acid sequence selected from SEQ ID NOs: 147-156.

8. The bispecific antigen binding protein of claim 1, wherein VH2 comprises a sequence that is at least 90% identical to an amino acid sequence selected from SEQ ID NOs: 200-230.

9. The bispecific antigen binding protein of claim 1, wherein:

(a) VL2 comprises the sequence of SEQ ID NO: 147 and VH2 comprises the sequence of SEQ ID NO: 200;

(b) VL2 comprises the sequence of SEQ ID NO: 147 and VH2 comprises the sequence of SEQ ID NO: 201;

(c) VL2 comprises the sequence of SEQ ID NO: 148 and VH2 comprises the sequence of SEQ ID NO: 202;

(d) VL2 comprises the sequence of SEQ ID NO: 148 and VH2 comprises the sequence of SEQ ID NO: 203;

(e) VL2 comprises the sequence of SEQ ID NO: 148 and VH2 comprises the sequence of SEQ ID NO: 204;

(f) VL2 comprises the sequence of SEQ ID NO: 148 and VH2 comprises the sequence of SEQ ID NO: 205;

(g) VL2 comprises the sequence of SEQ ID NO: 148 and VH2 comprises the sequence of SEQ ID NO: 206;

(h) VL2 comprises the sequence of SEQ ID NO: 149 and VH2 comprises the sequence of SEQ ID NO: 207;

(i) VL2 comprises the sequence of SEQ ID NO: 148 and VH2 comprises the sequence of SEQ ID NO: 208;

(j) VL2 comprises the sequence of SEQ ID NO: 148 and VH2 comprises the sequence of SEQ ID NO: 209;

(k) VL2 comprises the sequence of SEQ ID NO: 148 and VH2 comprises the sequence of SEQ ID NO: 210;

(l) VL2 comprises the sequence of SEQ ID NO: 150 and VH2 comprises the sequence of SEQ ID NO: 211;

(m) VL2 comprises the sequence of SEQ ID NO: 151 and VH2 comprises the sequence of SEQ ID NO: 212;

(n) VL2 comprises the sequence of SEQ ID NO: 151 and VH2 comprises the sequence of SEQ ID NO: 213;

(o) VL2 comprises the sequence of SEQ ID NO: 152 and VH2 comprises the sequence of SEQ ID NO: 214;

(p) VL2 comprises the sequence of SEQ ID NO: 148 and VH2 comprises the sequence of SEQ ID NO: 215;

(q) VL2 comprises the sequence of SEQ ID NO: 151 and VH2 comprises the sequence of SEQ ID NO: 216;

(r) VL2 comprises the sequence of SEQ ID NO: 151 and VH2 comprises the sequence of SEQ ID NO: 217;
(s) VL2 comprises the sequence of SEQ ID NO: 151 and VH2 comprises the sequence of SEQ ID NO: 218;
(t) VL2 comprises the sequence of SEQ ID NO: 153 and VH2 comprises the sequence of SEQ ID NO: 219;
(u) VL2 comprises the sequence of SEQ ID NO: 154 and VH2 comprises the sequence of SEQ ID NO: 220;
(v) VL2 comprises the sequence of SEQ ID NO: 155 and VH2 comprises the sequence of SEQ ID NO: 221;
(w) VL2 comprises the sequence of SEQ ID NO: 147 and VH2 comprises the sequence of SEQ ID NO: 220;
(x) VL2 comprises the sequence of SEQ ID NO: 147 and VH2 comprises the sequence of SEQ ID NO: 222;
(y) VL2 comprises the sequence of SEQ ID NO: 147 and VH2 comprises the sequence of SEQ ID NO: 223;
(z) VL2 comprises the sequence of SEQ ID NO: 147 and VH2 comprises the sequence of SEQ ID NO: 224;
(aa) VL2 comprises the sequence of SEQ ID NO: 147 and VH2 comprises the sequence of SEQ ID NO: 225;
(ab) VL2 comprises the sequence of SEQ ID NO: 156 and VH2 comprises the sequence of SEQ ID NO: 226;
(ac) VL2 comprises the sequence of SEQ ID NO: 156 and VH2 comprises the sequence of SEQ ID NO: 227;
(ad) VL2 comprises the sequence of SEQ ID NO: 156 and VH2 comprises the sequence of SEQ ID NO: 228;
(ae) VL2 comprises the sequence of SEQ ID NO: 147 and VH2 comprises the sequence of SEQ ID NO: 229; or
(af) VL2 comprises the sequence of SEQ ID NO: 147 and VH2 comprises the sequence of SEQ ID NO: 230.

10. The bispecific antigen binding protein of claim 1, wherein the binding protein is an antibody comprising a first light chain (LC1) and a first heavy chain (HC1) from a first antibody that specifically binds to human CGRP receptor and a second light chain (LC2) and second heavy chain (HC2) from a second antibody that specifically binds to human PAC1 receptor.

11. The bispecific antigen binding protein of claim 10, wherein LC1 comprises a sequence that is at least 90% identical to the sequence of SEQ ID NO: 71 or SEQ ID NO: 72.

12. The bispecific antigen binding protein of claim 10, wherein HC1 comprises a sequence that is at least 90% identical to a sequence selected from SEQ ID NOs: 86-91.

13. The bispecific antigen binding protein of claim 10, wherein:
(i) LC1 comprises the sequence of SEQ ID NO: 71 and HC1 comprises the sequence of SEQ ID NO: 86; or
(ii) LC1 comprises the sequence of SEQ ID NO: 72 and HC1 comprises a sequence selected from SEQ ID NOs: 87-91.

14. The bispecific antigen binding protein of claim 10, wherein LC2 comprises a sequence that is at least 90% identical to a sequence selected from SEQ ID NOs: 232-241.

15. The bispecific antigen binding protein of claim 10, wherein HC2 comprises a sequence that is at least 90% identical to a sequence selected from SEQ ID NOs: 243-311.

16. The bispecific antigen binding protein of claim 10, wherein:
(i) LC2 comprises the sequence of SEQ ID NO: 232 and HC2 comprises a sequence selected from SEQ ID NOs: 243-253, 290, 291, 294-301 and 308-311;
(ii) LC2 comprises the sequence of SEQ ID NO: 233 and HC2 comprises a sequence selected from SEQ ID NOs: 254-263, 266-271, 280, and 281;
(iii) LC2 comprises the sequence of SEQ ID NO: 234 and HC2 comprises the sequence of SEQ ID NO: 264 or SEQ ID NO: 265;
(iv) LC2 comprises the sequence of SEQ ID NO: 235 and HC2 comprises the sequence of SEQ ID NO: 272 or SEQ ID NO: 273;
(v) LC2 comprises the sequence of SEQ ID NO: 236 and HC2 comprises a sequence selected from SEQ ID NOs: 274-277 and 282-287;
(vi) LC2 comprises the sequence of SEQ ID NO: 237 and HC2 comprises the sequence of SEQ ID NO: 278 or SEQ ID NO: 279;
(vii) LC2 comprises the sequence of SEQ ID NO: 238 and HC2 comprises the sequence of SEQ ID NO: 288 or SEQ ID NO: 289;
(viii) LC2 comprises the sequence of SEQ ID NO: 239 and HC2 comprises the sequence of SEQ ID NO: 290 or SEQ ID NO: 291;
(ix) LC2 comprises the sequence of SEQ ID NO: 240 and HC2 comprises the sequence of SEQ ID NO: 292 or SEQ ID NO: 293; or
(x) LC2 comprises the sequence of SEQ ID NO: 241 and HC2 comprises a sequence selected from SEQ ID NOs: 302-307.

17. The bispecific antigen binding protein of claim 10, wherein
(a) LC1 comprises the sequence of SEQ ID NO: 72, HC1 comprises the sequence of SEQ ID NO: 87, LC2 comprises the sequence of SEQ ID NO: 232, and HC2 comprises the sequence of SEQ ID NO: 250;
(b) LC1 comprises the sequence of SEQ ID NO: 72, HC1 comprises the sequence of SEQ ID NO: 87, LC2 comprises the sequence of SEQ ID NO: 232, and HC2 comprises the sequence of SEQ ID NO: 243;
(c) LC1 comprises the sequence of SEQ ID NO: 72, HC1 comprises the sequence of SEQ ID NO: 88, LC2 comprises the sequence of SEQ ID NO: 232, and HC2 comprises the sequence of SEQ ID NO: 251;
(d) LC1 comprises the sequence of SEQ ID NO: 72, HC1 comprises the sequence of SEQ ID NO: 88, LC2 comprises the sequence of SEQ ID NO: 232, and HC2 comprises the sequence of SEQ ID NO: 244;
(e) LC1 comprises the sequence of SEQ ID NO: 72, HC1 comprises the sequence of SEQ ID NO: 87, LC2 comprises the sequence of SEQ ID NO: 232, and HC2 comprises the sequence of SEQ ID NO: 252;
(f) LC1 comprises the sequence of SEQ ID NO: 72, HC1 comprises the sequence of SEQ ID NO: 89, LC2 comprises the sequence of SEQ ID NO: 232, and HC2 comprises the sequence of SEQ ID NO: 253;
(g) LC1 comprises the sequence of SEQ ID NO: 72, HC1 comprises the sequence of SEQ ID NO: 90, LC2 comprises the sequence of SEQ ID NO: 232, and HC2 comprises the sequence of SEQ ID NO: 247;
(h) LC1 comprises the sequence of SEQ ID NO: 72, HC1 comprises the sequence of SEQ ID NO: 90, LC2 comprises the sequence of SEQ ID NO: 232, and HC2 comprises the sequence of SEQ ID NO: 248;
(i) LC1 comprises the sequence of SEQ ID NO: 72, HC1 comprises the sequence of SEQ ID NO: 89, LC2 comprises the sequence of SEQ ID NO: 232, and HC2 comprises the sequence of SEQ ID NO: 246; or
(j) LC1 comprises the sequence of SEQ ID NO: 72, HC1 comprises the sequence of SEQ ID NO: 91, LC2 comprises the sequence of SEQ ID NO: 232, and HC2 comprises the sequence of SEQ ID NO: 249.

18. A pharmaceutical composition comprising the bispecific antigen binding protein of claim 1 and a pharmaceutically acceptable excipient.

19. A method for treating or preventing a headache condition in a patient in need thereof comprising administering to the patient an effective amount of the bispecific antigen binding protein of claim 1.

20. The method of claim 19, wherein the headache condition is migraine.

21. The method of claim 20, wherein the migraine is episodic migraine.

22. The method of claim 19, wherein the headache condition is cluster headache.

23. The method of claim 19, wherein the bispecific antigen binding protein is administered to the patient as a prophylactic treatment.

24. The bispecific antigen binding protein of claim 5, wherein CDRL1, CDRL2, and CDRL3 of VL2 have the sequence of SEQ ID NOs: 131, 141 and 142, respectively, and CDRH1, CDRH2, and CDRH3 of VH2 have the sequence of SEQ ID NOs: 157, 165 and 195, respectively.

25. The bispecific antigen binding protein of claim 5, wherein CDRL1, CDRL2, and CDRL3 of VL2 have the sequence of SEQ ID NOs: 131, 141 and 142, respectively, and CDRH1, CDRH2, and CDRH3 of VH2 have the sequence of SEQ ID NOs: 157, 166 and 195, respectively.

26. The bispecific antigen binding protein of claim 1, wherein VL2 comprises the sequence of SEQ ID NO: 147 and VH2 comprises the sequence of SEQ ID NO: 200.

27. The bispecific antigen binding protein of claim 1, wherein VL2 comprises the sequence of SEQ ID NO: 147 and VH2 comprises the sequence of SEQ ID NO: 201.

28. The bispecific antigen binding protein of claim 10, wherein LC2 comprises the sequence of SEQ ID NO: 232 and HC2 comprises a sequence selected from SEQ ID NOs: 243-253.

29. The method of claim 20, wherein the migraine is chronic migraine.

30. One or more isolated polynucleotides encoding a bispecific antigen binding protein, said bispecific antigen binding protein comprising a first binding domain that specifically binds to human CGRP receptor and a second binding domain that specifically binds to human PAC1 receptor, wherein the first binding domain comprises a first light chain immunoglobulin variable region (VL1) and a first heavy chain immunoglobulin variable region (VH1), and the second binding domain comprises a second light chain immunoglobulin variable region (VL2) and a second heavy chain immunoglobulin variable region (VH2), and wherein VL1 comprises a CDRL1, a CDRL2, and a CDRL3 having the sequence of SEQ ID NOs: 6, 13, and 17, respectively, and VH1 comprises a CDRH1, a CDRH2, and a CDRH3 having the sequence of SEQ ID NOs: 35, 39, and 44, respectively.

31. An expression vector comprising the one or more isolated polynucleotides of claim 30.

32. A host cell comprising the vector of claim 31.

33. A method for producing a bispecific antigen binding protein that specifically binds to human CGRP receptor and human PAC1 receptor, comprising: culturing the host cell of claim 32 under conditions that allow expression of the antigen binding protein; and recovering the antigen binding protein from the culture medium or host cell.

34. A bispecific antigen binding protein comprising a first binding domain that specifically binds to human calcitonin gene-related peptide (CGRP) receptor and a second binding domain that specifically binds to human pituitary adenylate cyclase-activating polypeptide type I (PAC1) receptor, wherein the binding protein is an antibody comprising a first light chain (LC1) and a first heavy chain (HC1) from a first antibody that specifically binds to human CGRP receptor and a second light chain (LC2) and second heavy chain (HC2) from a second antibody that specifically binds to human PAC1 receptor, wherein LC1 comprises the sequence of SEQ ID NO: 72, HC1 comprises the sequence of SEQ ID NO: 87, LC2 comprises the sequence of SEQ ID NO: 232, and HC2 comprises the sequence of SEQ ID NO: 245.

35. A pharmaceutical composition comprising the bispecific antigen binding protein of claim 34 and a pharmaceutically acceptable excipient.

36. A method for treating or preventing a headache condition in a patient in need thereof comprising administering to the patient an effective amount of the bispecific antigen binding protein of claim 34.

37. The method of claim 36, wherein the headache condition is migraine.

38. The method of claim 36, wherein the headache condition is cluster headache.

39. The method of claim 37, wherein the migraine is episodic migraine.

40. The method of claim 37, wherein the migraine is chronic migraine.

41. The method of claim 36, wherein the bispecific antigen binding protein is administered to the patient as a prophylactic treatment.

42. One or more isolated polynucleotides encoding a bispecific antigen binding protein, said bispecific antigen binding protein comprising a first binding domain that specifically binds to human CGRP receptor and a second binding domain that specifically binds to human PAC1 receptor, wherein the binding protein is an antibody comprising a first light chain (LC1) and a first heavy chain (HC1) from a first antibody that specifically binds to human CGRP receptor and a second light chain (LC2) and second heavy chain (HC2) from a second antibody that specifically binds to human PAC1 receptor, wherein LC1 comprises the sequence of SEQ ID NO: 72, HC1 comprises the sequence of SEQ ID NO: 87, LC2 comprises the sequence of SEQ ID NO: 232, and HC2 comprises the sequence of SEQ ID NO: 245.

43. An expression vector comprising the one or more isolated polynucleotides of claim 42.

44. A host cell comprising the vector of claim 43.

45. A method for producing a bispecific antigen binding protein that specifically binds to human CGRP receptor and human PAC1 receptor, comprising: culturing the host cell of claim 44 under conditions that allow expression of the antigen binding protein; and recovering the antigen binding protein from the culture medium or host cell.

* * * * *